United States Patent 12,746,261 (PROBIOTIC BACILLUS COMPOSITIONS AND METHODS OF USE) - sequence listing, part 4

SEQ ID NO: 5 - DNA, 4090715 bp, Bacillus amyloliquefaciens (residues 2,045,359-4,090,715 of 4,090,715)
aaaaaaggcaaatgaacagaaatatgttggaagagtggggagtctggtcctatgcagattattcacagggtaaccgttatgcaggttctgaccgagcaaagcaaggaaaagcttttggcctcttttgcagaaaaaaagcaaacgcttgaacgagaatgcagccagctctattttcagcttagaaaacatgaaaaagatcagcagaatcccgatgtagcggaatcttttaaaaaagccattgaaaaaagacaagataaaatcaaaatgattgatttccaaataagccagacagagtcgctcccgcttggaagcgaagtgaaggaaaaggagatcgatgcgctgctttcaatcaacgtcggtgataactggcatgaaaaaacagcggcaaataccatcgtcataaaagacggggtagtaattgaaatccgcccgaggtgataatatgacaaacagatggtttaatgtaggcaaaattgtaaatacccacggcattaaaggcgaagtgcgggtcatttctaaaacggactttgccgaagaacggtacaagcccggcaatacgctctatttgtttgcggaaggggctgcggagccaatcaaagtaacggtcagcgcccacaggcttcacaagcagtttcacctgctgcaattcaaagaaatgccgagtctcaatgaagtcgaacacctaagaaacatggtgatcaaagttcctgaagaagacttgggagagcttgaagaagatgaattttattttcatgaaatcatcggctgcgaggttgtgtcagaagacggggaactgatcggcacagtgaaggaaatcttgacgcccggggctaatgacgtatgggtggttgcaagaaaaggcaaaaaagatgcgctcattccgtatatagcttctgtggtgaaggatattaatataaatgagaagaaaattaagattcatgtaatggaagggttaatagacgaatgaaaatcgactttttaacactgtttcccgaaatgtttcaaggggtgctcggctcatccattctgcaaaaagcacaggaaaaagaggctgtccgttttgacgtcatcaatttccgggctttttcggataataaacaccaaacggttgatgattacccgtacggcgggggagccgggatggtgttaaagccgcagcccgtatttgatgcggttgaaaagctgacagccggtacggacgccaagccgcgcattattctcgtctgcccgcaaggtgagcgttatacgcagaagaaagccgaggagctggcggaagaggaacatctcatgtttatttgcgggcattatgaagggtatgatgaacggatccgggaacatcttgtcactgatgaaatctccatcggggattttgtgctgaccgggggagagctccctgccatgatgattgccgacagcgttgtcaggcttttgccgggcgtcctcggaaaagaagcatcccacgtggaggattccttcagcacggggcttttagagcatcctcactatacgaggccagccgattataaaggcttaaaagtgcctgagacccttttgtccggcaaccatgccaaaatacaagaatggcgcaataaagaatcaatcagaagaacctttttaagacgtccggatcttcttgaaaactatcctctcactgatgagcaaagaaaatggatttccgagtgggaaaacgaatagattctattgcgcaggtgatgaagatatgataagatactacttgtggcttaaggaggcttatccttcagaagcttgaaaacgatgttccgctgtgccttgcagttgtggccaagagcatctgttggaaggagttgaaaacgatgcaaaaactaattcaagatatcacaaaagaacagcttcgcactgatcttcctgcgttccgtcctggtgacactttacgtgtacacgtaaaagttgttgagggtaaccgtgagcgtatccagatcttcgaaggtgttgtgatcaagcgtcgtggtggtggaatcagcgaaacgttcacagttcgtaagatttcttacggtgttggcgttgaacgtacattccctgtacacacaccaaaaatcgcgaaaatcgaagttgtacgttacggtaaagtacgtcgcgctaagctttactacctgcgtgaacttcgcggaaaagcggctcgtattaaagaaatcagacgataatgataacgaacgaaaagagcttgttacccgtaacaggctctttttttatatgaaatttgtaaaagcggaacaagcaacgtaaaatacataagagatcatcggaacatccggttccggtaaataaggcaggtgtcgaagtcacatgaccattcaatggttcccgggccatatggctaaagcgagacgggaagtaacagaaaaactgaaattaattgatatcgtatacgaattggtggatgcgagaatcccgatgtcatcgagaaatccgatgattgaggagattttaaaaaataagccgcgcattatgcttttaaataaagccgataaggcggatgcggctgtgactgcccagtggaaggaccactttcaggaacagggcattccctctctttcaataaactccgttaacgggcagggactgcatcaaatcgtgccgtcctcgaaagagctgctgaaggataagttcgataaaatgaaagcaaaaggtgttaggccgagagcaatccgcgcattaatcatcggcattccgaatgtcggcaagtctacgctcattaaccggctggccaaaaaaaacattgccaagacgggagacaggcccggcattaccacttcacagcagtgggtaaaggtaggcaaggaattagagctgctcgatacaccgggaattttatggcctaaatttgaagatgagcttgtcggcttgcgcctggcgatcaccggggcgattaaagatacgattatcaacctgcaggatgtggctgttttcgggctgcgctttctggaagagcattatcccgaccgtttgaaggagcgctacggacttcaggaaatccctgaggatatcgccgctcttttcgacgcgatcggtgaaaaacgcggctgtttgatgggcggcggaatggttgactatgataaaacaacggaagttatcattcgggacatccggacggaaaaattcggcaggctttcatttgaagcaccatcagaataaagacgcgcagcgatgcgggtctttattttttccgcagaataccgatatacataatgtaagggagaagagaacgtgaatacattaaccgtaaaaagcgtaaaagaacgcctgcaagagatcagggacgaaagcgaccccttccttgcccaatgtgagaaagacccgagaaaaagcgtacagacgcttttagagcaatggctgaaaaagcatgcgaaggaaaaagctcttaaagagcaatggctggacatgacggcatacgaaagactgtcatccaaaaagggcttccgcctgattgcgggtgttgacgaagccggaagagggccgcttgccggaccggttgtcgccggcgccgtcattttgccggcagaatgcgagattctcggtctcacggactcgaagaaattgtcggaaaagaagctcgaggagtattacagccggatcacggaagaagcggcggctgtaggagtcggcattgtccatgcggacgtcattgaccggatcaacatttatgaggccgcgagactggcgatggtaaaagccgtcaatgctttaacggaaacacctgattatctgcttgttgatgccatgacccttccgcttgacattccgcagtcatcagttataaaaggggatgccaaaagcgtgtcaattgccgccggagcctgcatagcaaaagtaacgcgggaccgtctcatggctgagtacgccaaaacttaccccatgtacggctttgaaaaaaataaaggctacggaacgaaagaacatcttgaagctcttcaggcatacggaccgacaactattcaccgaaaaacgttcgctcccgttcaatcttattgttagaaaagaggcttaagacatgaacattagcggcgaaatccaagcggctttcagacagctgacggcggaaatccctccggaccggcaggacggcggtaaagacagcggtactcaaaggctgctgttagggaaggttctccgtttgctggacgatcaaagcgctcttatccagatcggcggccggacgatgcagggaaaacttgaaaccgcccttcgtccgcaggcgtattactggttttcttatgacaaacagccggcggaaaaaacgggccggcttcatgtcatcgaccaattcgaaggaagcccgaaaaccgttcaggaagcggcgggtagactgttaaacgctctttccgtcaaaccgggccctgtgtctctgcatattgccgaaacgtttatgcagcagaagctgccgatgacggaaaacagcctcaaagcctgcgtccgctgggctgaatcgcttccggccgccgaattgaaaaaagcggcggaaacaatcgtatttgcgctgaaacgggaactgcccgcacatccggaagtcttgtcagccattcatgccgttaaatatccggttccgacccggcgcctcctctcaggactgcttcaggcaatcaatcaggcaccgcaatcggcaaaagagctgtctgtgctcaaagaggcggtttctgacgtattaaacgcggaaacggatcttcatgcagaacgtctcttgaagaagcttgccgaggctgcacgcatgccgatcccagaaaccgggctgatggatgaagaagaacggacggaatcaaaacaatcaccatttgtccgagagactcgtgaaaacggaaaggcagtctcaagccaaccttctcctccgagtgcgcggacagatcaaaaacttcctgaaaaaacggcaaaacagattatagagaaattaatgacatcggcagaaaaaactgaaaaccgccccgtaaaagtaacggcggagatcattaaggctttcatttctcaagaaaaaacatttaaaacagcacctgttcttcaaaaagcacatctgacagaacaggaggcggctgttttcgaaaaagccgttcagctcaccgaattgaaatatgcggaaaaacatgatgtattaagccttttgcagaaaatcaaaaaaggattgggcacgcgtgatgaattatcattcattacagcgcttgaaaaaggcgtatctccgcagccggagaaacaagcgctgaaaacggccctccaagccgtccggacgcttcaagaagcgccccaatccgttaaacaagaggcggaaccgcttattcataaattaaacggccagctgtttattgagcagcataacccttcttttacgcagatggtgctgtcatttccgctgggagcgtccgcgtatgagaatgacatcacagttctctttaaaggacggaagaagccggacggaaaactcgatccgtcacattgcaggctcctgtttttgctgcatcttgaaacactgcaagaaaccgttgtggactgcgtgattcagcaaaatgtaatgaccattacggttgagactgattttgagcttcaggcggccatcgaccctctcgtaccggctttaaaagaagccgtaaaagaaacgggcttcagcctgtcaggcgtcacgtctaaaaaacggcgcccgaaagaccagagcgctcttgtggaagagtttatagaaaaagacggcggaagaaaagtggatgtgaaaatatgaaagagcaaacgccgttaagaagagctgtcgccctgcattacgaccggcagaaagaccaagccccgaaggttgtcgcaacaggcagggggcacgtggcggaaaatattataaaagaagctgagaaggctggggtccccattcaggaagacagaacccttgtcgaattaatgcgccatttgacggttgacgatcacataccggaggcgctctatgaaaccgttgccgaaattttttcatttgtttacagactggacaaaaccctgaaaaacgaaaaataaggaccattcatttcccggactccgtttaaatttatattttcaataaaataaaagttagaatgtttggaaggatataaagattttgttttgaaccctagacaattcttccagtattatatagaatgaaagcgcagtctatttttagttttgctacataagttaggaggatgggaaatgaatatccatgagtaccagggaaaagaagtcctcagaaaatacggggtgtctgttcctgaaggtaaagtggcttttacagcagaggaagcagttgaaaaagcagagagcctgtcaagctcggtttatgtcgtaaaggcgcaaatccatgctggcggccgcggcaaagctggtggggtaaagattgcaaaaacaaaagatgaagtgaaagagtatgccgaagaactgttaggcaagacgctcgtcacacatcaaacgggtccggacggacaagtaataaaacgcttacttattgaagaaggctgcgatattaaaaaggaatactatgtcgggcttgtacttgaccgcgctacttcaagaatcgttttaatggcgtctgaagaaggcggaacggagattgaagaagtagcggaaaaaacacctgaaaaaattaaaaaagcggtaattgatccggctgtcggccttcagggctatcaggcaagggaaattgcattcgcaattaacatcccgaaagagcttgtcggcaaagccgctaaatttatgctcggtttatataaagcatttgttgagaaggactgctccatcgccgagatcaaccctctcgtcgttacgggggacggaaacgtcatggcgctggatgctaagctgaacttcgacagcaatgcgttatacagacaaaaagacattatggaatacagagatttagatgaagaagatccgaaagaaatcgaagcgtcaaaatacgatttaagctacatttcccttgatggaaatatcggctgtatggtaaacggcgcgggtcttgcaatgtctacaatggatatcattaaacactacggcggagaacctgcaaacttccttgatgtcgggggcggcgcaaccgcagaaaaagtgacggaagcttttaaaatcattctttccgatcaaaacgtaaaaggaattttcgttaatattttcggaggcatcatgaagtgtgatgtcatcgccgagggcgttgttgaagcgacgagacaagtcggattgacattgccgctggtcgtgcgccttgaagggacaaacgtagatttaggaaagaaaatcctgaatgaatcaggcttaaacatcacatctgcggaatcaatggcagacggcgcacagaaaatcgtatccttagtttaggaaagaatgaaaggcaggggaccagataatgagtgtttttatcaataaagatacaagagttattgtacaggggattacaggttctaccgctttatttcatacaaagcagatgctggaatacggcacgaatatcgttggcggtgtaacacctggaaaaggcggaacggaagcggaaggcgtaccggtattcaatacggtcgcagaagcggttcatacaacgggcgctgatgcgtcagtcatttacgtgccggctccgtttgcggcggacgcaattatggaagcggttgacgcggaaattgatcttgtcatttgtatcactgagcacattccggttttggacatggtgaaagtgaagcgctttatggaaggcaagaaaacgagattaatagggccgaactgcccgggtgttattacacctgaagaatgcaagatcggcattatgccgggatacattcataaaaagggtcatgtaggcgttgtatcccgttcaggaacattgacatacgaggccgtccatcagctttcagaagccggcgtaggccagtctaccgctgtaggaatcggcggcgatccggtcaacggcacgaactttattgacgtgttaaaagcgttcaatgaagatcctgaaacacatgccgtcatcatgatcggagaaatcggcggcacagctgaagaagaagcggctgagtgggtgaaagcgaacatgacgaagcctgttgtcggctttatcggcggtaaaaccgcgcctccgggaaaacgcatgggccatgcgggcgccatcatctccggaggaaaaggcacggcagaagaaaaagtcaaaacgatgaacgcctgcggaattgaagtcgcggaaaccccttctgtaatgggtgaaacgctgattaaggtgttaaaagaaaaaggcttatttgaaacgtgcaaaacgcactgatcgaagcaggggcagccgtaacggctgttcctgtttttgctgaaaaaagaggaggttgccagatttggatcaagcatcgcgctgtttaatggtctgcagtattaatcaaatcatttccccgtctcttctattaaaatggtggaaagctgatcactctctgtcttttttttcggatccgcatccattaactgttttatcagaggggaaaacagccccggaagcaatttttcgggaaatagagcgcaaggatccggaacttgatgaagttctgtccgattaccgccgcgaaggcattactgttattccgatttcatcaagctgctacccaacatggcttaaagcgatttatgatccgccggctgtcttgtatgcaaaagggaacacaccgcttcttgaaaaaggcagaaaaatcgggattgtaggaacgcggaaaccgacggaagacggaataaaagcggctgggcatctttccgccgaactctcaaaaaaaggctgggtcattgtaagcgggcttgcatccggtatagacggtttgtctcataaggcgagcatcagggcaaaagggcttacgatcggcgtgatagccggcggattccatcacatctatccccgggaaaatctcctgttagcagaatacatggctgaacaccatctcctactctcagaacatcctcctgaaacaaagccgaaaaaatggcactttccgatgagaaaccgcataatcagcggactaagtgaaggaattgtggtcgtgcagggaaaagaaaaaagcggttcattaatcacagcttaccaggccctcgatcaaggcagagaggtatttgccgttccgggttccatatttaatccatattccggaggacctataaaactcattcaagaaggggcgaaagctgtattatgcgcagaggatattgacggagagctgaccgcccgatgcgttcagtatacggaacccttttgaaatatcgtttgacaaacggtattgtaatatttaataatagtgaggatttaaagttgcatattattttcatgtataaaatgacgttcatcataaagaatgaaatgttgaaagccataaaaaggcagctctaaaatgaattgatacttgaaaagagagagaacacctcttgagggggatgaaaatgtctgattatctagtcatcgtggaatcgccggcaaaggcgaaaacgattgaacgttatttagggaagaaatataaagtcaaagcttcaatgggacatgtccgggatcttccgaaaagtcaaatgggagttgacatcgaacagaactttgaaccgaaatatattacgatccgcggaaaaggccctgttttaaaagaattaaaaacagcggcaaagaaagcaaaaaaagtctatctcgcggccgaccccgacagagaaggagaagcgattgcatggcatctcgcacacagccttgatctggatctcagctcggactgccgggtcgtctttaatgaaataacgaaagacgccattaaagaatcatttaaacatccgcgcatgattaacatggatcttgtcgatgcgcagcaggcgcgccgcatactagacagactcgtcggatacaaaatcagcccgattctttggaaaaaagtaaaaaaaggcctcagtgcgggccgtgttcaatccgttgcgctccggctgatcatcgaccgggaaaaggaaatcaatgactttaaacctgaagagtactggacgattaccggctcatttttaaagggaaaagagacgtttgaagccggatttttcgggaaaaacggcaaaaagcttcctttaaaaagcgaagaagacgtaaaagccgtccttgctcagctgaaaggcaataagtatacagttgacaaggtgacgaaaaaagagcgcaaacgaaatcccgctctgccgtttacaacgtcaactctgcagcaggaggctgccaggaagctgaatttcagagcgaagaaaacgatgatgatcgctcagcaattatatgaaggaattgatctcggcaaagaagggacagtcggactcatcacgtatatgagaacggactcaacgcggatttccaatacagccgttgaagaggcgtcagcttttattgatcaggcatacggaaaagagtacttagcgggaaaacggaaaccggcaaagaaaaatgaaaacgctcaagatgcccacgaagcgatccgcccgacttcggtgctcagaaaacctgccgacttaaaagcggtgcttggaagagaccagctcagactatacaagctgatttgggagcgttttgttgcaagccagatggcgcctgccgtacttgatacgatgagcgtcgatctcagcaataacggattgacattccgggcaaacggaagtaaagtcaaattcgccggcttcatgaaagtctatgtagagggtaaagacgatcagctggaagaaaaagaccgcatgcttccggaccttaaagagggagacacggttttatcaaaagatattgagcctgagcagcactttactcagccgcctccgcgttacacagaggcgcgcctggttaaaacgcttgaagaactggggatcggccgtccttcgacatatgcgccgactcttgacaccatccagcgccgcggttacgtgggattagacaataaacggtttgtgccgactgagcttgggcagatcgtgctggatcttatcatggagtttttcccggaaatcatcaacgttgaattcacggctaaaatggaaagggaccttgaccatgttgaagatggcgagacagaatgggttcaaatcattgacagcttctataccgatttcgaaaaacgcgtgaaaaaagcggaagctgaaatgaaagaagtggaaattgaacctgaatacgcagatgaagattgtgaattatgcggctcccggatggtttataaaatgggccgatacggtaaatttatggcgtgttccaacttccctgactgccggaatacaaaaccgattgttaaacaaatcggcgtaaaatgtcctaagtgccatgaaggaaatattgtcgaacgaaaatcaaaaaagaaacgcgtcttttacggctgtgaccgttatcctgaatgcgacttcgtatcttgggacaaaccgattgaacgaaaatgcccgaaatgtgaaaatatgctcgtagagaaaaagcttaaaaaaggcatacaagtccaatgcgtcgaatgcgattataaggaagaaccacagaagtagcggtgagcagagccttgctcaccttctttgtgtggaagggacaaacaacaggagatgaaaagaaatgaaccagcaaacagttaatgtaatcggagcaggccttgccggaagtgaagcggcatggcagcttgcaaaacgaggaattcaagtaaaactatacgaaatgcggcccgtcaggcagacggcagcccatcatactgataaattcgctgaactggtatgcagcaactccctccgttcaaatacactcgccaatgcggtaggcgtattaaaagaagaaatgcgggcgcttgactcagcaatcattcaatctgctgataaatgctcggttccggcagggggagcgcttgccgttgaccgccatgaatttgcgcaaagcgtgacggatctcgtgaaaaaccatccgaacgtaacggttcttactgaggaagtaacagagattccggaaggcccgacggttatcgcgaccggaccgcttacatcagaatcgctttcacagcagctgaaagagctcacgggagaagagtatctgtatttttatgacgcggcggcgccgattgtcgaaaaagacagccttgatatggataaagtgtacttaaaatcccgttatgacaagggagaagcggcatacttaaactgcccgatgacagaggaagagtttgaccgtttctatgaagcattgacgacggctgagacggttcctttaaaagaattcgagaaagaaatcttctttgaaggctgcatgccgattgaagtcatggcgaaaagaggcaagaaaacgatgctgttcggaccgatgaaaccggtcggactggaagatccgaaaacaggcaagcgcccttatgcagtcgttcagctcagacaggatgacgcggcgggaacgctttataatattgtaggttttcagacacatttaaaatggggagatcaaaaagaagtgctgaaactgatccccggccttgaaaatgttgatatcgtcagatacggcgtcatgcacagaaacacatttatcaactcgccgagccttttgaacccgacatatcaatttaaacagcggaacgatctgtttttcgcgggccaaatgaccggtgtagagggttatgttgaatctgccgcttcaggtcttgtagcgggaatcaatgccgccaaacttgtgctcggtcaggatcttgtgacattcccgcaggagacggcgatcggaagcatggctcactacattacgacgacaaatcagaagaacttccagccgatgaatgcaaacttcggcctcttaaaagaattgcctgtaaaaattaaaaacaaaaaagaacgaaatgaagaatacgctaaacgcgcaattgagactattcaaactatttcgaaaacgatatagcttttcattgcaacttcgatgcattatatgataccatttaaaagcccttcggagagggaggtcttcataatgactgagaatgttaacttttttttaaagttattcgttgaatatttacaaattgaaaaaaattattcacaatatactattgtgaattatgttaattcgattgaagaatttgggatgtttctgcatgctcaaaatataaatggaatgaaagaagctgcatatcatgatgtgagaatatttttgacagaggcttatgaaaaaggcctgtcaagaagaacaatcagcaagaaaatttcagctttgagaagcttctataaatttttaatgagggaaaagcttgttgaagagaatccgtttcagcttgttcatctgccgaaacaagagaaacggattccgaagtttctttatgaaaaagaacttgaggaactattcgctgtctcagacagaagtcagccgtcagggatgcgcgatcaggccctgcttgagcttctttatgcgaccggaatgagggtcagtgagtgctgtacgctcactgtcggcgatcttgacctgttcatggatacggtgctcgttcacgggaaaggcaagaagcagcgctatatcccgttcggctcatatgcccgtgatgcgctggagctgtatatcaacagcggaaggcagtgcctgcttgaaaaagcaaaagagcctcatgatgtgctgtttgtcaatcaaagaggcggcccgctgaccgccagaggaatccggtatattttaagcgggcttgtaaaaaaagcatccggcactttacatatacacccgcatatgcttcggcacacgtttgcgactcatctgctgaatgaaggggctgatttaagaagcgtccaggagcttttgggccattccaatctgtcttctacgcagatatacacgcatgtatcgaaggaaatgctgagaaacacatatatgtcccaccacccgagagcttttaaagaaaattaaaaggaggcccttctcatgtcatcttttcatgcgacaacgatttttgccgtccagcataacgggaaaagcgctatgtcaggagacggccaggtcacattcggtcaggctgtagtcatgaaacataccgcgagaaaagtgagaaagctgtttaacggaaaggttctggccggatttgcgggatctgttgcagacgctttcacactttttgaaatgtttgaggcgaagcttgaagaatacaacggcaatttaaaacgtgcgtcggttgagcttgcgaaagaatggcgcagcgataaagtgctgcgcaagctggaagccatgctgattgtcatgaaccaggataccttgcttctcgtatcgggaacaggtgaagtgattgagccggatgacggaattttggcaatcggctccggcggaaactacgccctgtcagcaggaagagcgctgaaaacctatgccggagagaatctgtccgccaaagatattgcaaaagccgctttgaaaatcgcaggcgagatttgtgtgtacacaaacgatcagatcattttggaagaacttgaatagaaaggacttgaggcgcatggaaaacaaaccgttaacaccgagacaaatcgtagatcggttggatcaatacattgtaggacagcaggatgcgaaaaaagctgtcgccgtggcattaagaaaccgctatcgcagaagtcttcttgatgaaaaactgagagacgagatcgttcccaaaaacatcctgatgatgggcccgaccggggtggggaaaacagagatcgccagacggatcgccaagcttaccggtgcgccatttataaaaattgaagcgacaaaatttacagaagtcggctatgtaggcagagatgtcgaatcaatggtcagagacctcgttgagacatccgtgcggctcattaaagaagaaaaaatcagcgaagtgaaagaacaggctgaagaaaatgcaaacaaacgtatcgtgcggcttctcgttccgggaaagaaaaaacaagcgggtgtgaaaaatccgtttgaaatgcttttcggaggaagtcagacggcaaatgatgatgaagccgatcagcaggaagaagcaagccttgaagaaaaaagaaaacgcatggcgcatcagctcgcattgggagagctcgaagaccattacgtctccgtagaggtggaagagcagcagccgtcgatgtttgacatgctgcaaggctccgggatggagcagatgggcatgaatatgcaggatgcgctgagcaatctgatgccaaaaaagaaaaaacgccgcaaaatgacggtcagagaagcaaggaaggttctgaccaatgaagaggcaggcaaattaatcgatatggatgaagtcggccaagaggccgtgttaagagctgaagagggcggcattatctttattgacgaaatagataaaattgcaaaaaacggaggggcttcttcctcagcagatgtatcgagagaaggcgttcaaagagatatccttccgattgtcgaaggatctaccgtcgtcacgaaatacggctccgtcaaaacagatcacgtgctgtttatcgcagccggggcattccatatggccaaaccgtctgatctgattccggagctgcagggccgctttccgattcgtgtagaattgagcaagctgacggtggatgattttgtgaagattctcgtcgaacccgataacgcgctgttaaaacaatatcaggctttattgcagacagaaggtatatctcttgaattttctgacgaagctattcgtaagatcgccgaagtggcttatcatgtgaatcaggatacggacaacatcggagcgagaaggcttcacacgatattggaacgtctcttggaagacctgtcgtttgaagcgccggacgtgacgatggaaaaagtcgccatcacgccgcaatatgttgaagaaaagctcggaacgattgcaaacaacaaagatctaagtcaatttatattgtgaaaatttaataagaggaattctaggaggattatttatcatggctttactacaaaaaacacgaattattaacagcatgctgcaggctgcggcaggcaaacccgtaaactttaaagaaatggctgaaacgcttcgtgacgtcattgattctaatattttcgtcgtcagccgcagaggaaagcttttgggctactctattaatcagcagattgaaaatgaccgcatgaaaaaaatgcttgaagaccgccagttcccggaagagtacacgagaaatctgttcaatgttccggagacgtcttcaaaccttgatatcaacagcgaatacacggcatttcctgtggaaaacagagacctgttccaagcgggcttaacaacgatcgtgccgatcatcggcggaggagagagactgggcacgctgattctgtcccgtctgcaggatcaatttgaagatgatgatctcattcttgctgaatacggagcaaccgttgtaggaatggagattttaagagaaaaagcggaagaaatcgaagaagaggcgcgaagcaaagcggttgttcaaatggcgatcagttctctgtcttacagtgaacttgaagcgattgagcatatctttgaagagcttgacggaaacgaaggcttgctcgtggcaagtaagattgcagaccgtgtcggcattacgcgttcagtaatcgttaacgcgctgagaaagctggaaagcgcaggcgtcattgaatccagatctctgggtatgaaggggacgtacattaaagttctgaacaacaaattccttattgaattggaaaaccttaaatctcattaagacaaaagcaggatccctgaaaatgggggtcctgctttttttatggacaataggtgaaaagttgcagtttaaagttgcttattggaagctgatctgagataatccatcttgctgtgtgaaaaaaggaggaagatacagaaattctgctattttcagtcttatattaaacaaatacttgtagtccaaatactctaggacttaatacctacatgcaaaatagatataattgagcacttttttttagcctaacttcatagactttaagcctgttatttcttacaataagcatatggttttacaattctcgacaaggatttttaggagaaaaatatctgaaatggaggtaagtggatttggacttattttctggaactatacaaaatcttgagaatgccttggggagagcggacattaagcaaaaagtcttaactaataacatcgccaatatagatacaccgaactataaggcaaaaaaagtctctttccgaaatttgttagatcaggaaacatccaatcttgaggcggtaaaaaccgactatcggcacgttgactttacgggttcaagggacgattattctatcgtgtccagcagtgatacatcgtaccagcaaaacggaaacaatgtcgatatcgacaaagaaatgacagatttagccgaaaaccaaattaattatcaggctttggttgaaagaatgagcggcaaattcaattctctgaaaaccgtcttgacaggaggaaaataatgagtggctttcaaagcttaaatatttcgggttccgctttaactgcacagcgtgtccggatggacgtcgtatcgtccaacctggccaatatggacacaacgagagcgaagcaggtaaatggcgaatgggtgccttacagaagaaagctggtatctctccaatccggaggcgaatcattttcgtcccttttacattccaagatgaacggaacaggaagcgcgggaaatggcgtaaaggtatctggcgttacggaagacccgtccgcttttaatctcgtttatgatccggagaatcctgatgcgaataaagacggatatgtacaaaaaccaaatgtagacccattaaaagaaatggtggatcttgtcagcagcacgagatcatatgaagcaaacgtaactgcattaaacgcctccaaaggcatgcttttaaaggctttagaaatcggaaagtaaggtgatgtaagtggttaacgctattactccttttcagcttcaacaaacccaaaacactcaaaacgtaacgaatcaattaaaccaaactcaaaaaactgattcttcaaaccaaacaagcttttcggagcttttaaaaaactctattgattcgttaaatgagtcacaagtaaaatctgaccaaataacgaacgaactggctgcaggaaaggatgtaaaccttgacgaggtcatgatcgctgcccaaaaagcaaatatttctctgacggccgctaccgaattccgcaataaagccgtggaagcctatcaggaaatcatgagaatgcagatgtagtggtcagattgaagagaatgactggaatgaccgggggttaacatgaatcgtactctaatgcaaatgaaaaccaaaacggcagcgttttggaacaacagatcaaaaacacagaagatactcatggtaagcggcttggccgcattcattattttactcatcgtcgttattatttttacttcgtctgaaaagatggtgcctctttataaagatttgtccgcggaagaagcggggaagattaaagaagagctcgatacgaaaaaggtgtcttctgaacttgctgacggcggcacggtcataaaggttcctgagagccaagtggattcgcttaaagtccagcttgccgcggaaggcctgccgaaaacgggatcaattgattattcgtttttcggacaaaatgcgggcttcggcctgacagataatgagtttgacgttttaaaggttgaggcgactcagaccgaattgtcaaacctgataaatgaaatggacggtattaaaagctcgaaggtcatgatcaatatgccgaaagaagccgtgttcgtcggtgaagatcagccggcagcgtccgcatccatcgttttgcagatgaaaccgggctactcgcttgatcaaaaccagatcaacgggctgtaccatctcgtttctaaaagtgttccgaacttaaaagaagataatatcgtcataatggatcaaaattctacatattatgacaaaagtgacagcggtgcagggtccgtttctgacagttatgcatctcagcaaggtattaagtcgcaggtcgaaaaggacattcaaaaacatgttcagtcactgctcggcacaatgatggggcaggataaggtcgttgtttctgtaacggcggatattgacttcacgaaggaaaaacgcactgaagacactgtcgaacctgtcgataaagataacatggaaggcatagcggtaagcgccgaaaaagtcgcggaaacgtataaaggcgatggcgcggccaacggcggcacggccggaacgggaagcaatgacaccgcgaactatgccgagacaaacggcggttcaaacagcggggactacgaaaaaagcagcaataaaatcaactatgaagtcaaccgcattcataaagaaatcgcggaaagcccgtataaagtgcgtgatttaggcattcaggtcatggtggagccgcctaatccgaaaaatgccgcttccttatcggcacagagacaggctgatatacagaagattttaggaacggtcgtcagaacgtctcttgataaaaacgaaacgcaaaatcaaaacctgacagacaatgatatcaacaataaaatcgttgtatccgttcagccgtttgacggaaaaacaagcctgaacacagattcggcacaatcttcaggtcttccgatctgggtatatattacaggcggcgtactgcttgcggccattattctgcttatcattctcctcatcagaaagaaacgctcacaagaggatgaatacgaagaatatgaatatgaaacaccgccggagccggttcgattgcctgatatcaacgaagagaaaattgaaacggaagaaacagtcagacgaaaacagcttgaaaaaatggctaaagaaaaaccggaagactttgctaaattgcttcgaagctggctggacgaggattagggggaatggaaaatggcgaaacgtgatcagaacaagcttacaggaaaacaaaaagcagccatcctcatgatttccttaggccttgatgtatcagcttctgtgtacaagcatttgtctgaagaagaaattgaaaggttgactctcgagatttcgggagtcagaagcgtcgatcatcaaagaaaagatgaaatcattgaagaatttcataatatcgcaatcgctcaggactatatttcacaaggcggtttaaattacgcccgccaagtgcttgaaaaagcgctcggagaagacaaagcggtaagcattttaaacaggctcacctcttctttgcaggtaaagccgtttgattttgcgagaaaagcggagcccgaacagattttaaatttcattcagcaggaacatccgcaaacgatggcgctgattttatcctaccttgacccggtgcaggccggacagattttgtctgagctgaacccggacgttcaggctgaggtggcaagaaggattgcggttatggacagaacgtctcctgaaatcataaatgaagtggagcgggtccttgaacaaaagctgtcctcctcctttacgcaggattatacgcagaccggcggcatagaagccgttgttgaagtgttaaacggcgtagacagaggaacggaaaaaacgatccttgattcattagaaatccaagatcctgaattggcggatgaaatcaaaaaacggatgtttgtctttgaagatattgtcacccttgataaccgtgcgattcagcgcgtgatcagagatgttgaaaacgacgacctcctgctttcattgaaggttgcgagcgaggaagtcaaagagattgtcttcagcaatatgtcacagcgtatggttgaaacatttaaagaggaaatggaaattatggggcctgtgcgtttgcgtgatgtggaagaggcgcaatcaagaatcgtgggcgtcgtccgcaagctggaagaagccggagaaattgtaatcgcgcgaggcggaggagacgatattattgtctaatatcattaaacagcaaacatcattttctcctgaacaaaaacggcgcaagctatccttgcaggaagtcaggaaaacacattcccagccagaccgggaggaacctgaaaatccggaggcactcatggcctttgccaaggccgaagccgacagggtgtctgaagaagcgaaaagtcaattggatcacactcttcggcagattgaagaagagaaaaaccgctgggcggaagaaaaacaaagattgattgaagaagcgaaggcagaaggatataaagaaggcatggcattgggaaaagccgatgctcaagcagaatatgccaatctcatcagccgggccaatgccgttatggaaatggccagacaatcagtcgaggaaaaactggaaagcgctgaggaagaaattattgagctttctgttgcgctcgctaaaaaagtatggcggcaaaaaagtgacgataaagaggctttccttctgctggtcaaacaggtagtagccgaagtaaaagattatgatgacatctccatctatgtggaccctgaatattatgagacggttcatcagcatatggacgaaattcagcagctgttatacaaagaatgcagattaagcttatatgccgatgaaaaagccgcgaagggaacgtgctcgatagaaactccgttcggacgtgttgatgcaggcatagacactcagctgatgcaattaaagcaaaagcttttaacggcgcttgaggcgggagcggagcaatgaagacacagtatttaatagactcaattgaaacagcggatccgtacaaacgctacggcaaggttaaacgggtcatcgggctgatgattgaatcaaaagggcccgaaagctcaatcggagatgtttgtctcatttatccgaaaggccatgcgaaaaaagcgattaaagctgaggttgtaggcttccaggatgaaaacattctgctaatgccttatctggaagcggccagcatagcgccgggcagcattgtggaggccactggcgagtcgctccgcatcaaagtaggggcgggtttaatcggacaagttgtcgacgcgttcggcgaacctcttgacggccgggcgcttccgaaaggtttgtcccccgtttcgacggaacagccgccgccaaacccgatgaaacgcccgccgatacgggaaaagatgggtgtcggcgtcagatcgattgacagtctgctgacggtaggaaaagggcagagaatcgggatttttgccggaagcggagtcggaaaaagcaccttgatgggaatgattgcgaagcagactgaagctgatttaaacattatcgcacttgtcggtgaacgggggcgcgaggtgcgtgaattcatcgagaaggatttaggcgaagaaggcctgaaacgctcgatagtcgtagtcgcgacctctgatcagcctgcgttaatgcgattgaaagcggcgtatacggccaccgccattgcggagtatttccgcgataaaggccggaatgtgatgttcatgatggactccgtcacgagggtcgcgatggctcagcgggaaatcggcctggcagcgggagaaccgccgacaacaaagggatatacaccttctgtgttcgctattttgccccgtttgctggaaagaacgggcgcaaatgaacaaggaacgataaccgctttttatacggttctcgttgacggagatgacatgaacgaaccgattgccgatacggtgcgcggaatattagacgggcatatcgttctcgatcgggcgcttgccaacaaaggacagttcccggccgtgaacatcctgaaaagcatcagcagggtcatgtctaatatttcagacacagcgcacatagaggcggccaacaaattccgcgatcttctgtcaacttatcaaaactctgaagatctcattaatatcggagcttacaaaagagggtcatcaagagaaattgatgaagcgattcagttttatccgcagcttattcaatttttaaaacaaggaacggaagaacctgctcaattggaagacagcattgcggcattgacgagtctgacaggaaaagaggaataaacatcatggcgtaccaattcagatttcaaaagctgctggaattaaaagaaaatgaaaaagaccaaacattgactgaatacagacaatcggtttctgaatttgagacagtggctgaaaaactatatgaaaatatgagcaaaaaagaattgctcgaaaaagacaaagaatcaaagctgaaatgcgggatgagcgttcaggaaatgagacattatcagcaattcgtttccaatcttgagaacaccatctatcattatcaaaagcttgtcatcatgaaacgaaatgaaatgaatgagaagcaggaacagctcaccgaaaaaaacattgaagtaaagaaatttgaaaaaatgcgggaaaaacaatttaatatgttcgcacttgaagacaaagctgcagagatgagggaaatggatgacatttcaatcaagcagtttatgattcaggggcattaggagcgaatgaaatggccgaaaaagaaaagagatctggaaagttcggttcaatcctgctttttatcatgatcccgctgatttttctgatcatcgtcgcaagcatcatcctttgggctgccggcgttgatgtgatgaagccgattcaggaaacagccgctaaaacgcctgttttaaaagaattggttcccgaaacgaaagaaatgaaaagcgcggcggaaaagcagaaggaagacagaacggcttctcttgaaaagaccataaaggaacaaaaaagtgaaattaacattttgaataaagatttagatacaagcaagtccgaaatcgataatctgaatcagaaaatccgttcgctgaaacaggaagctgaacagcagcagaaaacgaagacggatgaaacgaaaaaagacgcttcggattcagccggaaaagataaaatgatcaacatctataaaagtatggacagcggtaaagcggcaagcattatcgtaaagctgaaagaaaaagaagccctcgatattttaaacggattaagtaaaaagcagcttgctgaaatcttgacgaaaatgactcctgaacaagcggctaaatatacagaaaaactatccgctgacggaaataaggagtgatgtaagttgaagctgcttgaattaacgggtaatcgtacgcagactgcgcaaaacagcaatgtgaagatgaatgtaaacagcttaggtctatttcagaactggctcctgtcggaaatcacttctccccggcagcccggagatgaaacaaaaacaagtgacgcagagctgaatgatgccctatcgaaaatcggtgattggctgaaagccggcccggaagataaagaattgcagcttaaacagctgcttgaggcggtaaaagctcttgaaggaaagcagacggctgaaacagctcttcctttattgaaacagcttgccgaatccgttgaagacatgttagcgggaaaacagcatggggcgaagcctgaaacgaatgagccggattcttccgcaaaagacggggattccgtcaaggatgcgcttgagaagggcctgcttttcattcaagaagccgtattccagctcttcacatctcagcaggaactgccggacagcacgcaggcaaaggcggtttaccaggaaggcgcccgtttattagaggcattgaaaaaacaaggtgttccggaccgcgtgattcaagacctgcggcagacattttttccgaaaaacgaatctgcatctaaactttactccatgacagccgctgagctgaagagctttcaaagcgtcgcggagcagcttgcgggcctttctcaaaagggaacaaaggaatgggatatggctgaaactgagctgaaagcttttgtgttatctcaatcatctgaatcatcccaagagtcagccgggaaaacggaacagcaaaacggcggcacggtttctcacgcaaaggcgcctgacagcaaattgtctgcacatatactgttttcgggaacgagaagccttgccggcattcagcaagcgtccgcaggagctgaacagcagccggcagaaaataaaccgttaacggatcaggtcatcagcggctggaaacagatgaaatacacgcctttcgggaaaacaaccggaagctttacgattcgtcttaatcccgagaacctcggatttgtcacaattaaggtgacaaacgaaaacgggatgtttcaaagcaaaataatcgcatccagccagtccgcgaaagagctgctggaacagcatcttcctcagctgaaacagtcgcttccgaatatgtcggtccaggtcgaccgttttacagtcccgcttcaaggcggggatcagcagcctgtttacgggcagacggccgatcacaataaacagcagcatcagggacagagagagcagaagaacaagcagcagtcaggcgatttcggagatatgctggaggagctttctctcaatgaaatggaggaagaataggtgacatcagtaaactcggattatgccgcggcgggcgcttcaaccacttcaaacgcgaagagcacctccgcagtaaacagcagtacgaatttagggaaagacgaatttctgaagatcttaatgacacaggttcaaaaccaggacccgctcaatccggttgatgacaaagaattcatcagccagatggcgacattttcttcattggaacaaatgatgaatatgaatacgacgatgactaaatttgtagaaaatcaagatccgtttacgatgtatgtgaactggatcggcaaaaatgtcacattcagcgacagcgacgggaaggatcagacaagcccagtcaattcagtcaagcattcaaacggcaattacgtgctcgtgcttgaaaatggcaaagaggtcagtccgtggaatgtcacggccgtcagcgaaacatctaaataaaaagaaacccagggggaatttaacatgttacgttcattatattccggtatcagcggcatgaaaaactttcagacaaaactagatgtaatcggcaataacatcgccaacgtcaacacagtgggatttaagaaaagccgcgttacatttaaagatatgatcagccagacagtcgccggcggttcaaacgtgaccaattcaaaacaaatcggcctgggtgccgcgacttcttccattgatgtcgttcattcaaccggcgccccgcaggctacacagaataaaaccgacctagccattgacggagacggctactttcagattaatacaggttcgggaatcgtttacacacgtgcggggaatttcggaaaggacaatcaaggcaaccttgttacgactgacgggtactaccttgaaaaaatcggcggcggcaaaatcaatattccgactgatgcgaaagattacagcatcggtgcagacggaaccgttacatacactgatgcaggggatgcggttcatgatgccggacaaatcggtctggtcacgttccctaacagcgccggtctggaaaaaatcggaggcaacctttacagagaatcattaagttccggagctgcgagcgcagtcaccactccgggcgaaaacggaacgggtaagcttttggcaggctatcttgaaatgtcaaacgtagatctgacagatgaatttaccgaaatgatcgttgctcagcgcggtttccaatcaaactcaaaaatcattacgacttcagatgaaatccttcaggagctggttaatctgaaacggtaaggagggaggagaggcggttaggccgcttctccggattgcatgattcaagtcacccgtttaaacggccagccttttacgctgaacgcgctgtttatcgaacagattgagtgcttccccgacacgacgattacactgtccaacggcaaaaagttcgttgtgaaagaaccggaagaagcagttctcaaaaaagtcatatcgttttaccatagcatacaaatattttcactggatcagggaatagaggaagaagaatgaagaaaaaattagtcatcattttgctgattattttaattgtcatcgccggcctcggaacggcagcatattttgtcgtcagcggacattccggcaaagataaaaagccgacaattgacgaagtcgttgcagccactgtgtctgtcgacgatatcacgacaaacttaaagtctgacagcatcatccgtatcggcatcaagcttgaaaccgactcggctaaagcgaaggaagaacttgaaaaacgcgattttcaggtgaaagacaacatcatttccattttagctgacacaagcgccggagagattgagggagataaaggaagagaagcgtttaaacaatcattaaaagagaaagtaaacagctatctccaagaaggaaaagttcagaaagtgtacattacctcctttaatctgcaataaaaacaaatttgacagaatacggaggtgaagaaaatgtcaggagaagttctctcccaaaatgaaatagacgcactgctttccgccatttccacgggtgaggcggatgcggaagagctgaaaaaggaagttaaagagaaaaaagtaaaggtatatgattttaaacgggctctcagattctcgaaagatcagatacgcagtttaacccggatacatgataactttgcgaggcttctcacaacacacttttccgccaagctcagaacgtatattcatatatccgtcagctcagttgaccaggtgccgtatgaagaatttatccgttccataccgaacatgacgattttaaatttattcgatgttcatccgatggaaggcagaatcatgatggaggttaatcccaccatcgcatacgcaatgcttgaccgcgtcatgggaggcatcggcatcactcataacaaagctgacagccttacggaaattgaaacgaatattatttctaacttatttgaaaatgcactgggcaactacaaagaagcttggcaatcgattgctgatattgaccctgaaatgactgaatttgaagtgaatcctcagtttgtacagatggtttccccaaatgaaacagtcgttgtcatttctctcaatacacagataggtgaaatcagcggtgtcattaatctttgtattccccatgtcgtacttgagccgattatccctaagctttccgtacattattggatgcaatcagaccggaatgaagcgaagcccgaagaaacgaagctgcttgaaaagcgcatcatgacggctcaaattcccgttgtggctctcttgggcgcttctgaactgacaatagaagaatttttaagtttggaagtcggggactgtataactctggacaaatcagtgactgatcctcttactgtattggtcggaaacaaaccgaagtttttagggcaggccggccgggtgaatcgaagacaggcagtgcaaattttagatcacgacataagaggtgaacaagatgaacaatagattatctcaagatgaaatcgatgctcttcttaacggcacaagcagtcagtcagaggatacagaacagcctcaagaggcgaacttgtctgaacttgagcgcgatgcgatcggagaaatcgggaatatttcgttcggcagctcggctacggcgctgtccactcttttaaatcaaaaagtggacattacgacaccgagtgtgaccgtcatttcaaaaagcaaaatcagtgatgaatttcctcatccgtatgttgccattgaagtgaactacacagaaggctttgacggcagcaatttgctcgtcgtcgaacaaagcgacgcggcaatcatcgcggatttgatgatcggcggagacggccggggcgccgatccgtcactcggtgaaatccacctgagcgccgtgcaggaagcaatgaatcaaatgatgggctcggctgctacgtcaatgtcgaccgtattcagtaaaaagattgacatttctccgccaagggttgaacttctggatgtgacggaagaaaaagggaccgacagaatacctgaggatgacctgctcgtaaaagtgtcattccgtctgaaagtcggcgaattaatcgattcgagcatcatgcagctttatccgattacgtttgcgaaagatctgatcgcagacctgatgactgcggaccagcatgagtcagaggccgcagaaaccgcatcagaaccacaggaaacatacgaaacgccgcagccggaacctgccatgcagccggagccgcaggcaaaacccgagcttccgaagagacagggaaccgcaaaaaaagctgctcctgttcaagtcgctccggtagaattccaggcgtttgatcataacgaagcggcgcaaggatcaaggaataaccttgatatgctgatggatattccgctttccgttacggttgagctcggcagaacgaagagaagcgtcaaagaaatccttgaactttctgcgggaagcattattgagcttgacaagctggctggtgaacctgtggacatcctggtcaaccagcggatcgtggcaaagggcgaggtcgttgtcatagaagaaaacttcggcgtgagagtcactgatattttaagtcaggcagaccgccttaacaatttaaaataagcgaacatagaggagagaaacagattatggcacacagaattttaattgtagacgatgcagcatttatgagaatgatgatcaaggatattttagtgaagaacggttttgacgttgtagctgaagcttcagacggagcgcaggcagtcgaaaaattcaaagagcattcccccgacctagtgacaatggatattacaatgcctgaaatggacgggattacagctctaaaggaaattaaacagatcgatccgcaggcgaaaatcatcatgtgttcggctatgggccagcagtcaatggttattgacgcgattcaggccggcgcaaaagactttatcgtgaaaccgttccaagcggaccgcgtgcttgaagccattaataaaacattaagctaaagggtgtacgactgttgaaaaagagtcatggtttactagctttgatttgttatttcgttttactcaatgtacatccgttccctgcttttgcggcagagtctgataattccaccgtcaacgaatggtttgacaaacaatcaacaaacaaaacagagaaaaaaagcgatacatcgaaacaaacggctgatcaagagataggggatgcttctgcatcttctgtctccgcttttgattttgtaaagatgatcggggcgttattattcgtcattctgctgatctatggatttgtcaaactgatgaatagaagaaaccgtctgctgaagccgtttcaatatgtagaaaatatcggcggaacgtcagtcggccaaaatcgttccgtgcagctgattaaagtgggaaacagcgttctcgtagtcggtgtgggcgaaacgatacagcttttaaaagaaatagaagatgaaaaagagcgcgaggcgattctgagccaatacgaagagtcgatgtcttcaaaagtggaatggaccaagctcgtaaatccgcgtaaggatggagaaaaaaagccgcaaacgatgcttccgtcgttttcaaaagcgctgaaagaacagctgaacgagctgaaacaaagccgttctgaaggaaagaagaaaggcccttatcatcatgaatgaattcgttaatctttttaattcaagcaatccgaccgaagtcagctccactgttaaattactgctgcttttgactgtcttttcagtagcgccggggattctgattttgatgacctgctttacgagaatcgtcatcgttctgtcttttgtgagaacctcactggcgacgcagaacatgcctccgaaccaggttttaatcggccttgcgctgttcttgacgttttttattatggcgccgactttttcagagattaataaggaagccttaacgccgctgatggacaacaaaatcagtctcgatgaagcatatacaaaagccgagaagccgattaaagagtatatgagcaagcatacaaggcagaaggatctggcgctgtttatgaactatgccaaaatgaaaaaacctgaatcgattcaggatattcctttgacgacgatggtgcctgcttatgcgatatcagaactcaaaaccgcttttcaaatgggctttatgatttttattccgtttttaattatcgatatggtcgtggcgagcgtcttaatgtcaatgggaatgatgatgctaccgccggttatgatctctctgccctttaaaatattgcttttcgttttggtcgatggatggtatttaatcgtgaaatctttgcttgacagcttttagggtaggtgctaattgtgagttcagaatttgtaatttccatggcggaaaaagccgtatatgtaacactaatgatcagcgggccgctgcttgccatcgcgctgatcgtcggtttgctcgtcagtatctttcaagcgacaactcaaatccaggaacagacgcttgcgttcattccgaaaatcgtggcggtgatgcttggactgatctttttcggtccttggatgctgtcgacgattctttcgttcacaactgatctgttctctcatctgaaccgatttgcagggtagaatcaaatgaattccatcattgatttatttcccgcttttttattggtctttatcagaatctctgctttttttgtaacggtgccggtgttcggacatcggaatctgccggcggttcaccgaatcggctttgctttttttctttcggtgatctgcttcagcacgctgaaacatgcgccggaaatagaaataggggaacagtatatgctgcttgtcataaaagaggccgttgtgggcttgagcctcgggctgattgctttcatgatgatgacagccattcagatagcgggttcctttattgattttcagatgggcttttccatcgccaatgtcattgatccgcaatcaggaacgcaaagcccgctgatcggacaattcgtttatacgctggcgctgttatttatgctcagcgtaaacgcccattatcttttattggacgggatttattacagctttcagtatatcccgcttgatcaggcatttccgtcgtttggaaatgatcactttggactttttatcgcaaaaagcttcaatgccatgttcattatcgcttttcaaatgtctgcgccggttgtggccagtctgtttttagttgatttggcgctcggtattgtggcgagaacggtgccgcagctgaatgttttcgttgtcgggcttcctctgaaaatagccgtgagctttattatgctgatcgtttgtatggcggtgatgtttgtcgtcgtccgcaacatcttcagccttaccgttgaaaccatgcggaatctattggcattggtcggtgtgacatgatgagactcagactgaatctgcaattctttgccggtgaaaaaacggagaaagccactccgaaaaaacggaaggatacaagaaagaaaggacaggtcgcgaaaagtacggatgtgaatacagccgtttctttactgattatctttctttcgctgatcgcgctcggtccttatatgcgggacaggctgctgtcctttattaaaacgttttatacgaaatcgatatcattacatctgtcagcatcttccgtgcatgaactgttcgtagatacggtgaaagatatcagcctcatcctcgcgccgattatgctggtcgcgcttgtggcaggtgtcgtgagcaattacatgcaggtgggttttctgttttctgcggaagttctcaagcctgacttgaataagctcagcccgctgaaaggatttaagcggatttacagcatgagggcgattgttgaactggtcaaatccattttgaagattactgtggtcggttttgccgcctttatggtgctctggctgcattatggcgatattctccgccttccgcttttaacacctgcggaagtgctcactttcgtttctaagctcacgctttggatggggcttgcgggatcaggggctctaatgctgctggccgggcttgattatttatatcagcgttttgactatgagaaaaatatcagaatgtcaaagcaggatataaaagatgaatacaaaaaatcggagggtgatccgattatcaagtccaaaattaagcagaagcagcgggaaatggcgatgaggcggatgatgcaggaagtgccgaaagcggatgtcatcattaccaacccgacccattatgcgattgctttaaaatatgatgaaaagaaaatggccgccccttacattgttgccaaaggggtcgaccatcttgcattaaaaatcaggcagatcgccaaagaacacgatgtcatgacgattgaaaacaggccgctcgcgcgtgcgttatatgatcaggttgacattgaccaggctgtgccggaagagtttttcaaagtcattgcggaaattttggcttatgtatataaaacgaaacaaaaagtatagcgaatttcagattcaaaaggagagaaaaacagcatgtcaacaagagatttatcggttttaataagtgttgtcctcattgtggcaatgctggtgattccattccctccatggttgttaagtattttgatcatcattaatatctctcttgcgttgatcgtgcttctcaccacaatgaatatgcaagaaccgctgcaattctcgatattcccgtcattgctgctgttattgacgctgtttcggcttgcgctcaatgtgtcgacgacacgttcgattctttctcacggagaagggggaaaggttgttgagacattcgggaatttcgttgtcggcggaaatgtgctggtagggcttgttgtcttcattatcttaattattattcagtttatcgtcattacaaaaggcgccgagcgggtatcggaagtggcggcgagatttacgctcgatgcgatgcccggaaagcaaatgagtatagacgcggatttaaatgccggcatgattacggagcaggatgcaaagcacagacgtgaaaaagtcgcccgggaagcggatttttacggcgccatggacggtgcgagcaaattcgttaaaggggatgccatcgcggggatcatcatcgtgatgatcaatattattttcggaatcgtaatcggcatgctgcagcaggggatgagcatacaagaagctgcgtctcactttacaatgctgacggtcggtgacggtatcgtttctcaaatgccggccttgctcatttcaacggctacggggattgtcgtgacgagagcggcatctgaaggaaacctcggtcatgatattacaggccagctgtttgcttatccgaagctcttgtatgtagccgcgggaactgtacttttgctcggtcttcttacaccgatcggcattctgctgacggggccgatcgccggtctgcttgcattcggcgcttatatgctgtccaaagcggataagccgagcgaagaagaggaagaaattcttgaagaagaggctcaggcggatgaactgaaaagcccggaaagcgttgtgcagcttttacatattgatccgattgaatttgagttcggatacggactcgtgccgcttgcagacgcggggcagggcggtgatcttcttgaccgcatcgtcatgatcagacgtcagcttgcgcttgaattgggacttgtcattccggttgtgcgcatcagggataacatcgcactccagccgaatgaatacagattgaaaattaaaggcaatgaagtcgctaaaggagagctcctgctggatcattatttagcgatgtcaccgacgcctgaagatgacgtcattgaaggaattgaaacgattgaaccgtcgttcggacttcccgcaaaatggatcagcgaagctgcaaaagatgaagcggacatgctggggtatacagttgttgatccggcgtcagtcgtatctacgcatattacagaaaaaattaagcagcatgctcatgaactggtcggcagacaggaaacaaagcagctgatcgatcatctgaaggaaaattatcctgtgcttgtcgaggaagtcacgccgaaccctctttctgtcggcgatattcaaaaggtgcttgccaaattgctgagagaaaaagtttcaatcagaaacttggtgaccatttttgaaactcttgccgattacggaagattaacgacagattcagaccttttgacagaatacgcgagacagtcgcttgccaaacaaatcacggcacaatatgcgagagagcatgaaacgctgaaggtcatcacatgctcaggccgggtggaaaaagcgattgcagacggggttcagcagactgaacagggcaattacctgtcactcgaccctgaggtttcggacagcatcatccgttctgtcgctaaagaggccgagcagctttccatccgtcaggagtcggcgattcttctttgctcgcctgctgtcagaatgtatgtaaaacagctgttagaacggtatttccctgatcttccggttctttcttataatgagctggaagcaaatgttgaagtacagagcattggagtggtggatatttaatgaaaataaaaaaatttacagccgcttcaatgcaggatgccgcgaagcaaatcaaaaaggaactcggcaatgatgccgttattttacattccaaacaagtaaagaaacgaaaatggctggggctgcggtcgcagcaggccgtcgaagtgatagcggttttagatcgtgacgtcagggaagcgagaaaaacgccgccggctgccgctgaagaaatgaaaaagacggaaacggcggagaaagctgagcctgttcagccgccgcgccttccggatcaaagtatttccggcgaactggcgcatttgaaagaagtgctccctgaaccattaaaaaaagccgagagactattgaagcaagccgggcttcctgatcatacgcaaaacgctgtactcagtgaattgctcagttcttcaattgtttccggagatttaactgaagataatgtcagctcaaagctgcaggatttgttagtgaaaaaactcccttcgacagacaggtggcaggaagggattcaatcaaaatacgtcgtgcttttcggttcaaccggggccggcaaaacgactacacttgcgaaacttgcggcctcatcaatgctgacagagcataaaaaaattgcctttatgacgacggatacttaccggattgccgcggtcgagcagctgaagacatatgcggagctgcttcaggctcctcttgaagtatgctattcaaaggaagaatgtctgaaggcactggaaaaattcgctgaatacgaccatgttttcattgatacagccggcagaaactttaaagaagagcagtatattacggaattacaagagatgattccgtttgaatcaggcttacaatcctttctcgtattatcggcatctgcaaaatatgaagatatgaaacaggtgctgaaacagttttccggtgtgccggtcaatcaattcattttcacgaaaacggatgaaaccgcctcactcggctccgtgtttcaagtgctgtcggaatcaagaatcggcgccgcctatttgacaaatggacaggatgtgcctgaagacatcctatcggcttcaccaaaagagtttgtaaggatgcttttggcatgaaacccgatcaggcagagtcattaagaaggaaaatgagagagaggcaaatgatcaagccggagctttatgagaaaaaagcgaggacattagccgtcataagcggtaaaggcggcgtcggaaaatctaatttaacattaaacatggcagttgccctgcaggaaaaaggaaaaaaagcactcatcattgatcttgacatcggaatgggcaacattgatgtgctgatcggagctgcttcttcccgcaccattattgatgtgatggagaatcggcacgcgttggctcaatcactttcctccggtccgaaaggccttcgctacatatccggaggaacggggcttgaggcgttctatcaagcagacagagagaagtggtcggcttttatgaatggtctttccgctgtattaagcgattttgattacgttctgtttgatatgggagcgggactttcaaaagaacagctgccgtttattttatcggcggaagacattctcgccgtgacaacgcctgagccgacggccattatggatgcgtacagcgcgatcaaacatcttttgctcgcggatgaacggctgaccgtaaacattgccgtcaatcgcgcccgcgctcaaaaacaggcgctggacacgtacaaccgcctttctcatgcgatccacacgtttttaggcgcggaggtgcgtttcgccggctccatacccgatgatccgctagtaagtcaagccgtcattgaccaggtgccttttttaataaaaagtcctcaagcaaaagccagcaggtccgtccgtcttctgacggatgtcttgtttcaaacggaagaaaacaaaccaagagaagagaaaccggcatttattgagagattatcttcttttttattgaggaggactttacagtgattcgtgtgcttgtcgttgatgactcagcttttatgagaaagatgattaccgattttctggctgcggaagtgcagatagaagtcatcgggacagccagaaacggggaagaggcgctgaagaaaatagagcttctcaaaccggatgttgtcacgcttgatattgaaatgccggtcatgaacggaacggatacattgcggaagatcatcagcatatataaacttcccgtcatcatggtatcgagccagacacagcaagggaaggaccgaacgatcaactgcctggaaatgggcgcttttgattttatcactaagccttccggagcgatttcacttgatctttataaaattaaagagcagctgattgagagggtgattgcagccgggatgtcccgcgcacaaaaacctgaggcggcagtgaaagagtcttctatcccggaacgtccggctttggcgggatttgaaagaccgaaagcaaaatccgccaagcaggccgtattcatcgcgacctctacaggcggaccgcgggctctgcaaaaggtggttccgaaactgccgaaggatttaaaggcgcctgtatttgtcgttcagcacatgcctgaaggcttcaccgcttcacttgcagacagactcaaccatttgtcagatattcaggtcaaagaagcggaaaacggtgaagaagcgaaagacggatgggtgtacatcgcgcccggcggaaaaaatatgacggttgcagaggaaggcggaaggctccgcatcattcttgatgttcatgatacggaaagccggcataaaccgtcagccgattatttgtttcggtcggcaagccgtttatccggttacgaaaaggtagccgtcattatgacaggcatgggcagcgacggaaccgagggcgtaaaagaaatgctcagaacaggcggcgttaaaacgattgcggaatcggacgaatcctgtgttgtgtttggaatgccgaagtcagcgataaaggcgggcctcattcatgagattaaacatgtggaagatatcgcggcatccatcaccggatgtgtgaaaaaagagagggtgtgaatcaattggatatgaatcaatatttagatgtctttattgatgaaagtaaagagcacttacagacatgtaacgaaaagctgctgctgttggaaaaagatccggcagaccttcagcttgtgcatgacatcttcagagctgcccatacgctgaaaggcatgagcgcaacgatgggatatacagatctggcgcatttaacccacctgatggaaaatgtgctggacgccatccgcaacggagaaatgcccgttacatcggattggctggacgtgctgtttgaagcgcttgatcatcttgaagagatggtgcagtccattattgacggaggagacggcaaacgtgatatttctgaagtaagtgcgaagctcgacgtaaatgcggcgcatgagactgcggcttcagccgaaacagcagaaccgccggcttcaaaacaacagacttcaactgaatggaattatgatgagttcgaacggactgttattgaagaggcggaagagcaaggattcagccgctatgaaataacggtttccctgaatgaaagctgcatgctcaaagccgtgcgcgtgtacatgatatttgaaaagctgaatgaagccggggaagttgcaaaaacgatacccgccgcggaagtgcttgagacggaagatttcggaacggattttcaggtgtgtttcttgacaaagcagcctgctgaagaaattaaagaactcatcagcggcatttcagaagtggagaatgtcgaaatttctgccggtgcgccgttaaaaacggccgaaaaaccgcaagcagctgaaccggtgaaggaaactccggttaaaaaggctgaaaaacagccgaaaccgcaagcgaaaacggaagagcagccgaagcatcacagcggctcgaaaacgattcgcgtcaacattgaaagactggattcttcaatgaacctttttgaagaacttgtcattgaccgcggacgtcttgagcagatcgccaaagagcttgaccacaatgagctgactgaaaccgttgaacgcctgaccagaatttcgggcgaccttcagtctattattcttaatatgcggatggtgccggtagaaaccgtctttaaccgtttcccgagaatgatccgccagcttcaaaaggaattaaacaagaaaatcgaattgtccatcatcggagctgaaacggagctggaccgcacggtgattgatgaaatcggcgatccgcttgtccatttaatcagaaacagcatcgatcacggcattgaatcgcctgaagtgcgggtgaataaaggaaaaccggaatcgggtcatgtcgtgcttaaggcatatcacagcggcaatcatgtctttattgaagttgaagatgacggggccggcctgaacagaaagaaaattcttgaaaaagcgctcgagcggagtgtaattaccgaacgtgatgctgaaacgcttgaagataatgagatttacgagcttatttttgctcctggcttctcgactgccgatcaaatttctgacatttcaggtcggggcgtcggtctggatgtcgtaaaaaataaactcgaatcactcggcggctctgtcagtgtcaaatccgcggaaggccaaggttctcttttcagtatccagcttccgctgacactttcaattatatccgttcttctcattaaactggaagaagagacgtttgcgataccgatttcttctattatagagacggctgttattgataagaaagatatcctgcagacgcatgacagagaagtgattgatttcagaggacaaatcgttccgatcgtctatctcaaaaaagaattcggcattacagattcaaaacaggatgccgatcagttccatgtaatcgtcgtgaaaaagggcgataaatccactgcttttgtcgtggactcttttatcggacagcaggaagtcgtactgaaatcactcggcgactatttgacgaacgtctttgcgatttccggcgctacgattctcggaaacggagaagtggcgctgattattgattgcaatgcgctgatctactaaaacgacacgaggaggtgcccgcatgactgctgaaatcaaaacaggtgaaaaaatgattgtgtttatgataaacgggaaagaatacgctatctcagtttcccaggtgaaatcaattgaaaagtggcaaaaaccgacgagggtcccgggtgtggaatcgtatatccgcggcgttatcaatctgcgcggagtaattaccccggttcttgatttaagaaaacgtctgaaccagcctgaacaggacatcacagaagagacacggattatcatcatttcttaccgtgacgccgatgtcggatgggtcgtggatgaggccaatgacgtcatcaccgtgcatgaaaatgaaatcgaatccgcgcctgaaagccagacaaaggaaacggatgtgtggattaaacagatcgtcaagcaagataacaggctcctcaatattattgatgcgcatgcggtgctggataaaggtgcttcggcatctgcgtccggagagccgaatgcttaaaggggaaaagacaacatgagtaagtttgaagcgatcaaagaagagcagatggatattttgcgggaagtcggaaatatcggggcgggtcactcggcttctgccatggctcagctgctgaacagaaagatagacatggaagtgccgtttgcgactttattgacatttgatgagctcgctgattttttcggcggggctgaaacgccggtcgccagtatctttttaagaatggaaggcgacatgacaggctctatctttctcatcatgcctttccatcaggcggaacagtttatcagagagctgatcggaaatccggattttgatattgaccagttgggcgaagatcatttgagttcttctgctttacatgagttcggcaatattttagcaggttcctatttaacggcattggctgatttgacaaagcttgagatttacccgagcgtgccggaaatctcacttgatatgttcggcgcggttatcagtgaaggactgatggagctcagccaagtcggagagcatgccattgtcgtggatacttctatttttgaccagggcagccggcaggagctcaaagcccatatgtttatgctcccggactatgattcttttgaaaagctcttcgtctcattgggtgcggctttatgagccgtgcggaagccgcagtcgttaaagtggggattgcggatgttcaagtcgcgcgttatccggataaaatccggacttcgggactcggttcatgcgtggggctggttttatacgataaagacaaacaaacggcaggactcgttcacgtcatgctgccggactccggtttatcaaaaacggcggagctcaaccgtgcaaaatacgcggacaccgccgttaagatgacaattgatatgcttttgaaagccggctgccgcaagtttgccctgaaggcaaaactcgccgggggagcggagatgtttaagtttaaaatgacaaacgacctgatgaaaatcggtccgaggaatgtagcggctatcaaagagcagctttcattgtataacattccggtcatcagtgaagatacgggcggctcaagcggccggacgattgaatttgagccaaagtcctgcatgctgcacattcgaactgttaaacaaggtgaaacaacgatttaataaaggtatgaggtagggggataacaatgcaatccttgaattatgaagatcaggtgctttggtcgcgctggaaagagtggaaagatcctaaagccggtgatgatttaatgcgccgttacatgcctttggtcacatatcatgtcggcagaatttccgtcggactgccgaaatcggtgcataaagacgatctaatgagccttggtatgcttggtttatatgatgccctagaaaaatttgaccccggccgggatttaaaatttgatacctatgcctcgtttagaattcgcggtgcaatcatcgacgggctgcgtaaagaagattggctgcccagaacttcacgggagaagacaaaaaaagtcgaagcggcaatcgaaaaacttgaacagcgctaccttcggaatgtgacgccttcagagatcgcagaagagcttgggatgacggagcaggacgtagtatcaacgatgaatgaagggttttttgccaatctcttatcaattgatgaaaagcttcacgaccaggatgacggtgagaatattcaagtgatgatcagagatgacaaaaatgtgccgccggaagaaaaaatcatgaaggacgagctgatcgctcagcttgcgggcaaaattcacgagctctctgaaaaagagcagcttgtcgtcagtttattctataaagaagaactgactttgaccgaaatcggacaagtcctgaacctttcgacgtcgcggatttcacagattcattcaaaggcgctgtttaaattaaagcacctgcttgaaaaagtaattcaataatgaactcatggttagcgagtgaaaaacatgtcaacactattatggcttttaagctttgtgcttcacggcgtactgctttatgccgtcattattctgtacacgaggttttcagccctcaaggagacggagcgccagcagaagaagattcttgaagagacggaaaacacccttgcagcgtttctgcttgagctgaaagaagaaaatgaaagactcgaagacacaaaaagccggaatgatcaagcgcctgacgcagaagacgccgaaccccggccggaaccgaaaaaagagcctgatattccggatcacatggaaaagctcatcagtgcaacggaacgggctgaaagtgacgaaaacaacggtgcgcattcgtttgaagaacgtgtttcagaattatatgaacaagggctcacccctgcggaaatcgccaaacgggtgcagagcggaaagacagaaatcgagctgtttttaaaatttcgcggcaaagctgtaaaggattcttgattgtcgcataaagctgtgttatattatgtcttggtgttaaatacacacgcttaacgatttatgcagagggtgctgcaaacggcagttctgcacaaaaatgacctaagcggaggaaaaaaaccattttattaggaggaaatcacatgtcagttatttctatgaaacaattgcttgaagctggtgttcacttcggccaccaaacacgccgctggaacccaaaaatgaagcgttacattttcacggagcgtaacggaatctacatcattgaccttcaaaaaacagtgaaaaaagtagaggaagcttacaacttcacgaaaaaccttgctgctgaaggcggaaaaatccttttcgtcggcacaaaaaaacaagctcaggattctgttaaagaagaagctgtacgctctggcatgtactatgtcaaccaacgctggttgggcggtacactgacaaacttcgaaacaatccaaaaacgcattaagcgtctgaaagacatcgagaaaatgcaagaaaacggtacatttgaagtacttccgaaaaaagaagttgttcaattgaaaaaagaattagagcgtcttgaaaaattcctcggcggaattaaagacatgaaggatcttcctgatgcattattcatcatcgatcctcgcaaagagcgcatcgctgttgcggaagctcgcaaattgaacattcctatcatcggaatcgtagatacaaactgtgatcctgatgaaattgatgtcgtaatccctgcaaacgatgacgcaatccgcgctgtcaaacttcttacttctaaaatggcagatgccattcttgaagcgaagcaaggcgaagaagaagcggaagctgctgaagagactgcacctgaaacagaaacgacaactgcgtaacctaatcaaaaggtgataagagggactgccttttatcaccttttttcaagaaaaatgtatctatacatatcttgtttacacatataaggaggaattcaaatggctattactgcacagcaggtaaaagaactgcgtcaaaaaacaggcgctggtatgatggactgtaaaaaagcattgactgaaactgacggagatatggacaaagcaatcgaccttctgagagaaaaaggaattgcgaaagcggctaaaaaagctgaccgtatcgctgctgaaggttctactcttattaaaactgacggcaacaaaggcgttatcttagaagtaaactctgaaactgatttcgttgcgaaaaacgaaggcttcaaagagcttctgaacacgcttgctgaccaccttcttgcaaacgctcctgctgatcttgaagaagcgttgggtcaaaagatggaaaacggttctactgttgaagaatacatcacaagcaatgttgctaaaatcggagagaaaatcactcttcgccgttttgctgttcttacaaaagaagacagcgaagcgttcggtgcttaccttcacatgggaggccgcatcggcgtattatccgttcttagcggaacaactgacgaagatcttgcaaaagacatcgcgatgcatgttgcagcggtaaatcctcgttatatttcccgcgaccaagtgtctgaagaagaagcaaaccatgagcgtcagatcctgactcagcaagctcttcaagaaggcaaaccggaaaacatcgtagctaaaatggttgaaggccgtctgaacaaattcttcgaagaaatttgcttattagaccaagctttcgttaaaaacccagacgaaaaagtgaaacaagttgtggctgcgaaaaacgcatctgttaaaacttacgtccgctacgaagttggagaaggcattgaaaaacgccaagaaaactttgctgaagaagttatgaaccaagtgaaaaaataatggcggaaagccttggcgaatctttcgcggcttttcaggcagtataggggacactacttgtgttccctatttttaaaactatatttacaaacctttttttctcttgcataataggaaacggcaatgtttacacttggaggttattatggaaaaaccaaaatacaatcgtatcgttttaaagcttagcggagaagcattggcaggagagcagggaaacggcattaatccgactgttatccaatccatcgctaaacaggtaaaagaaatcgctgagcttgacgtcgaagtggccgtagttgtaggcggcggcaacttatggcgcggaaaaacaggcagtgacttaggaatggaccgtgcgacggccgattatatgggcatgcttgctactgtcatgaactcacttgccctgcaggacagcctggaaacgctcggaattcagtccagagtgcagacatcaattgaaatgcgtcaggtcgctgagccttatatcagaagaaaagccatccgccacctggagaaaaaacgcgttgtgatttttgccgcgggaacgggaaacccttatttctctacggacacaaccgcagcgctgcgtgccgctgaaatcgaagcggatgtgattttaatggcgaaaaataatgtcgacggtgtgtataatgccgatccgagaaaagatgagtcagctgttaaatacgaaaaattatcttatctcgatgtgttaaaagacgggctggaagtcatggattctacggcttcttcactatgtatggataatgatattccgctgatcgtcttttctattatggaagaaggaaatattaagcgtgccgtaatcggcgaatcaatcggaacgatcgtaagggggaaataacgttgtcaaacgaagtattaacacaaacaaaagaacgcatggaaaaagcggttgccgcttattcacgtgaattggcgtcagtccgcgcgggacgtgccaacccatctctattggataaagtgacagtagaatactacggtgcccaaacacctttaaaccagctgtcttccatcaatgtgcctgaagcgcgtatgcttgttgtcacaccgtatgacaaaacggcaatcggcgatattgaaaaagcgatcctgaaagctgaccttggcgtaactccgacaagtgacggcacaattattcgcatcgcgatcccggctctgacggaagaaagacgtaaagaacttgtcaaagtcgtgaaaaaatacgcggaagaagcgaaagtagcagtccgtaatgtccgccgtgacagcaacgacgacctcaaaaaacttgagaaaaacggggacattacagaagacgagcttcgtgcttccagtgaagacgttcaaaagctgacagatgaatatgtgtcaaaaattgacagcgtcacgaaagacaaagaaaaagaaatcatggaagtttaatgaaaaactatgtacaatagataatgtgaaaagaccctctcatgtttacagggggtttttttgttaatactgttgattacattgatcatcagcaacgcaacctttttgggtgacggaggaatctcatgctcaacatactcaaaaattggaagaatcagcagaatgcggcttccaacttagaacggtatacaaaagaagacatactgaagggtgaaattcccgcacacattgccattattatggacggaaacggacgctgggcgaagaagcgctcactcccgcggattgccggacatcatgaaggaatgaaagtggtaaaaagggtgacaaagctcgcaaatcagctcggcgttaaagttctgactctttatgcgttttcaacggagaattggaagcgaccgaagatggaagtcgactttttgatgaagcttccggaagagttcctgaatacgtatcttcctgaattgatagaggaaaatgtacaggtgaaaattatcggagatgaatccgcgctcccttctcatacgtacagggcgattgagaaggccgtaaaagatacagaacaaaatgacgggctgattctcaatttcgctttgaactacggcggacgcacggaaatcgtcaatgcggcaaaagcattggccgaacaggtgaaaagcggcacgctgaatatcgaagacattgatgaagcgctcttttccgggcatttaatgacagaatcaatccaggacccggaactgctcatcagaacgagcggagaaatcagactgagcaactttatgctttggcaggtggcttacagtgaatttgtttttacagatgtcctgtggcccgattttaaagaagatcactttctgcaggcagtgggagaatttcagcagcggggccggaggtttggcggaatttagaggatggtggaaatgaaacaaagactgttaacaggtgttctggcagcggcactatttttatttttggttattttcggaggattgccgttcaccgtatttgtttacgtgatgggaagtatagcgctttttgagcttttgcggatgaaaaagctcagatttttttcttttccgggtctgatcagcttcttgttgttatggctgtatatgatgccggacaaatatcattttttcgatgcgaaaatggaagtaacgattttcgccgtattgattctgctcagctatacggtgctcgtgaaaaacacctttacgtttgacgaagtcgggtttatcgttctcgcgacggtatatatcggactgtgttttcattattttattgaaatcagaaacattgaaacaaacgggcttttgtatatcttttatgcctgcgttgtcatatggtcaacggactcaggcgcatatttcgtcggaaagtcgctcgggaagcggaagctgtggcccgaaatcagtcccaacaaaacagtggaagggtttctcggcggtattgtcatcgcccttatttttacggccgtttttcagctgtttgctcaccttccgatttcatatccggttcttttggtcatcacgcttgttctgtctgtgttcggacagatcggggatttggttgaatcagcgcttaagcggcactatgatgtgaaggattcggggaaaatccttcccgggcacggcggcattttagaccgatttgacagctttttgtttgtcatgccgttcttatactttctgcttgcgcttttttcatgagaaaggctaatatgaaaataagaccgatctggacgcatagaatgggagtggcattttgaagaatatttgtcttttaggagcaacaggatcaatcggggagcagacgttagacgtattgcgcatgcatcaagatcagttccgtctcgtctcgatgactttcggtaaaaacgccgagaaagcgatcccgttgatcagaacgtttcagccgaaatatgtagcagtcggcgacatggatacatatcaaaaagtgaaagaagcgtctttttcgcatgaatgtcaaatcggcatcggagaagaaggcctgattgaagcggcagtcatggacgaagtggatatcgtggtcaatgcgctgcttggaagcgtcggtttaatcccgactttgaaagcgattgaacagaaaaaaacaattgcgcttgcaaataaggaaactctcgtcactgccgggcatatagtgaaaggacacgcaaaacgatacggtgttcctcttcttccggttgacagcgaacattccgctatttttcaggcgctgcaaggcgaacagagcaaaaatatcgagcgcctgatcattacggcatccggcggcagtttcagggataaaacgcggcaggagcttgagtctgtaacgattgccgacgcccttaatcacccgaactggtcgatgggtgcaaagattacgattgactcggctacaatgatgaataaagggcttgaagtcattgaagcgcattggctgtttgacattccgtatgaacagattgacgttgtattacataaagagagcatcattcattcgatggttgaatttcacgacagaagcgtcatcgcccagctcggaaatccggacatgagggtgccgattcaatacgcgctgacatatccggaccggctgcctctgcctgaaacaaaaaggcttgaattatgggagatcggaagccttcattttgcgaaagctgactttgaaaggttccgctgcttacaatttgcctttgaatcaggtaaaatagggggaacgatgccgacggttttaaatgcggccaacgaagaagccgttgccgcttttcttgccggacggatttcattcttatcgattgaggacctgattgaaaaagcattggaccgccacagcgtaattcaggatccgagtcttgcggatatccaagaagtggacaaagacacccggggatacgttaattcaatactcacataaggtggtatgttcgtgaatacagttatcgcgtttattattattttcggaacgctcgtttttttccatgagctcgggcatttattgctcgcccaaagagcgggaatcctttgccgtgaatttgcgatcggcttcggccctaaaatcttttcatttaaaaagaatgaaaccgtgtatacgatcagactccttccggtcggagggttcgtccgcatggccggtgaagacccggagatgatcgaagtcaaacccggttataccgtcgggcttctttttaataaagatgacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgctcggattcattcaaggcgtgccttcaaatcagcctgagctcgggaagctgacagacaatggacgcgcagctgctgccggtttaaaagaaggcgactatatccagagcattaacggtgaaaaaatgaggtcatggaccgacatcgtgacagcggtaaaagaaaatcccgggaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggagcgcttgcagcgattgcttacggcgcgacatctaccgttgatgtcacaaaagcgatcctgaccaatctgagcaaacttgtgacaggccagtttaagcttgatatgctttcgggtcctgtcggcatttatgatatgacggatcaagttgcaaaaaccggtattatcaacctattccagtttgcggcgtttttaagcatcaacctgggaatcgtcaacctgctgccgataccggcgcttgacggcggacggctgctgtttttattcattgaagcaatccgcggcaagccgataaaccgtgacaaggaagcatttgtcgtatttatcggcgtagctttcttaatgcttcttatgctggttgtcacatggaacgatatccagcgtttattcttataattgactagtaaaaaatcagaggtgcgaagacatgagacaaagtttgacgcttattccgaccctgagagaagtgccggctgatgctgaagcaaaaagccataagcttctgctgagagcgggatttatcagacaaaatacgagcggggtttacagctacatgcccctggcttacagggtcattcaaaacattcagaagatcgtgcgtgaagaaatggaaaaaatcaacgcggtggaaatgctgatgccggcccttcagcaggctgaaacatggcaggaatcaggcagatggtatacgtacgggcctgaattaatgcgtctgaaagaccgccacggccgtgaatttgctttaggcgcgacacatgaagaagtcattacttctctcgtgcgtgatgaggtgaaatcttataagcgtctgccgctcactctttaccagatccagtctaaattcagagatgaaaaacgcccgcgtttcgggttattgcgcggacgcgaattcatcatgaaagatgcgtattctttccatgcttctgaagaaagtctggaggaaacgtaccaaaacatgtacggcgcatacagcagcattttcgcacgctgtgaattaaacgtccgtcccgttattgccgactcaggcgcgatgggcggaaaagacacgcatgaatttatggctctttctgaaataggggaagataccatcgcttattccgatggatcctcttacgcagccaatacggaaatggcgaaagttgtcatgaacagcgagccgtcagatgaaacacccgaggcattggagaaaattgatacgccaaatgtcaaaagcattgaagagctcgcttcgttcttgcagatcgagccgagcgcctgcatcaaatcaatgctgtttaaagcggatgaccgatttgttctcgtgttagtaagaggcgatcatgaggtcaacgacgtgaaagtgaaaaaccttctgaacgcggaagtggttgagcttgcgtctcatgaagaagtagcggagaaacttggcacggagccgggatttgcggggccgatcggcgctgccggcgacattgagatttatgccgaccaagccgtgaaagtaatggtaaacgccgtttgcggcgcgaatgaaaaagaccgtcattaccgaaacgtaaacatcgaacgtgacgcgtctgtaaaagcgtatgccgatcttcgaatcattcaggaaggcgatccgtcacctgacggaaaaggcacgatccgtttcgctgaagggattgaggtcggacaagtctttaaactcggcacgcgttactctgaagcgatgaatgcgacataccttgatgaaaacgggcgtgcgcagccgatgctgatgggatgttacggaatcggcgtgtccagaacgctttctgccatcgctgaacagcatcacgacgaaaaaggcttgatctggccgaagagcgttgctccgtatgatcttcatattttggcgctgaatatgaaaaatgaagcgcaaaaagagcttgctgaacagctttacggaaaattccagacggaaggttatgaggttttatacgatgaccgcgctgaacgcgcaggcgtgaagtttgctgattctgatctgatcggccttccgatccgcatcactgtcggaaaacgtgccgacgaaggcatcgtagaagtgaaaatccgcaaaaccggtgaatctgctgaagtttcagtggatgagctttctgaatttattaagacgaagtaatcaccataacgaatcgtacaaaatcatgttaaaatagagaaaaaagaaggtacctcatcacctgcggaggtaccttcacttatgatgttttaagggagggatactgtctgaatggaacagttatcagtaaacagaagacagtttcagattcttctgcagcagcttaatatgacagatgataccttcatgacatactttgaagacggagagattgataaactgacaatccataaagcagaaaaagcctggcatttccaatttcgctttaaggctcttttgccgtatcaaatatacgattcattcatgatgaggttaacacaatcgtttgctcacatcgcccgtgtcacatcgtctgttcaggtcatcgatcctacagtgacagaggagcttgtacaggattattggacacgctgtattgaagagcttgaaggaacctcgccgccgatggtggctcttttgaatcagcagaagccgaagctcaagggaaacaaactgatcgtgaaaacaaaaacagatacagaagcatcggcgctcaaaaataaatacagcgcactgattcagcacagctatcgccaattcggatttccggaactgcagctggataccgaaattttcgtatctgaccaagaagtccagaaattccgcgagcaaaagcttgctgaagatcaggagcgggcgatgcaggcgcttatcgaaatggagaagaaggaaaaagagggcgatgaggatcaagcgccgtccggcccgcttgtcatcggctatcaaattaaagagaacgaagaaatccggacgcttgacagcatcatggatgaagaaagaagaatcacggtgcaggggtttgtgtttgatgctgaaacacgcgagctgaaaagcggacgcacgctctgcattttcaaaatcacggactatacaaacagtattttagtaaaaatgttcgccagagaaaaagaagacgccgctttgatgaaaacgctgaaaaaaggcatgtgggtgaaggcgcggggaagcattcaaaacgatacattcgtcagagacctcgtcatgattgcaaatgacgtgaatgaaataaaagccaaaacccgtgaagacaccgctcctgaaggcgaaaaacgggttgagcttcatctgcattctccgatgagccaaatggatgctgtaacgggcatcggaaagcttgtcgaacaggcgaaaaaatggggacatgaagcgattgcgttaactgatcatgccgttgtgcagtctttcccggatgcctattccgccgcgaaaaaacacggcattaaaatgatttacggaatggaagccaatatcgtggatgacggtgttccgatcgcatacaatccagctcaccgtcttttggaagaagacacatacgtcgtctttgacgttgaaacgacaggtctgtccgcagtgtatgacaccatcattgagcttgccgcagtcaaaataagaggcggagaaatcatcgataaattcgaagcgttcgccaatccgcaccatccgctgtcagcaacgacgatagagcttaccgggattacggatgacatggtccgcgacgctcccgatgtcgttgacgtcgtccgggattttaaagaatggatcggcgatgacgtgcttgtggctcataacgccagctttgatatgggatttttaaatgtggcgtacaagcgtctactgaaaacggaaaaagcgaaaaatccagtcattgatacgctggaactcgcgcgtttcctgtatcctgagtttaaaaatcaccgcttaaatacgttatgtaagaagtttgatatcgaattaacccagcatcaccgagcggtctttgacgctgaagcaacgggctacctgctgttgaaaatgctcaaagatgccgctgaaaaagacattttttatcatgatcagctgaatgagaatatgggacaatccaatgcttatcaaagatcaaggccttatcacgctacattgcttgccgtaaatgagaccggccttaaaaatctgtttaagctcgtgtctatttctcatattcaatatttctacagagtgccgcgcattccgaggtcgcagcttaataaatacagagaaggtctgttaatcggctctgcctgtgacaggggagaggtctttgaaggcatgatgcaaaaatcacctgaagaggttgaagatatcgcatcattctatgattatcttgaagtgcagccgccggaagtatacagacaccttctgcagcttgagctcgtccgggatgaaaaagcgctgaaagaaatcatcgccaacatcacgaagctcggggaaaaattgaataagccggtcgttgccaccggaaatgttcactatttaaacgatgaggacaaaatttaccggaagatcttaatatcttcccaaggcggcgccaacccgttaaacaggcacgaactgcctaaagtgcacttcagaacgacagatgaaatgctggatgctttctcctttctcggtgcggaaaaagcgaaagaaattgtggttgacaatacgcagaaagtcgcttcgatgatcaatgagatcaaaccgatcaaagacgatctgtacacgccgaaaattgacggagccgatgaagaaatccgtgaaatgagctatcagcgcgccagaagcatttacggtgaagagcttcctgaaattgtggaagcgagaatagaaaaagaattaaaaagcatcatcggtcatggattcgccgttatttatctcatctcccataagcttgtaaaacggtctctggatgacggttatctcgtcggctcccgggggtccgtcggttcatcgcttgtggcgaccttaacggaaattactgaagtgaatccgctcgctccgcactatgtgtgcccgagctgccgatattcggaattctttaatgacggatcagtcggttccggttttgaccttccggataaaagctgcccgtcttgcggcacacctttgaaaaaggacgggcatgatatcccgtttgaaacgttcttaggctttaaaggtgacaaagtacccgatatcgacttgaacttctcaggtgagtatcagccccatgcccataactacacgaaagtgctgttcggtgaagataacgtgtatcgcgcgggaacgatcggcaccgttgcggaaaagacggcttacggatatgtgaaaggctatgcgggtgatcacaacctacacatgcgcggcgcggagatcgaccgtctggtgcagggctgcaccggcgttaagagaacgaccggccagcacccggggggattatcgttgtcccggattacatggatatttacgatttttccccgatacaattcccggcagatgcgacggggtctgaatggaaaacgactcattttgacttccactccattcatgacaacctgctgaagcttgatatattggggcacgatgacccgacagtcatccggatgctccaggatttaagcggaattgatccgaagacgattccgacagatgatccggaagttatgaagattttccaaggtacagaatcgctcggcgtcactgaagagcagatcggctgtaaaacggggacgctcggtattcctgaattcgggacgcgatttgtgcggcagatgcttgaggatacgaagccgacgacgttctccgagcttgtccagatttccgggctttcccacggcacggacgtatggctcggcaacgcgcaggaactgatacacaacaatacgtgtgaactgagcgaagtgatcggctgccgtgatgacattatggtttacttgatttatcagggccttgagccttcactggcctttaaaatcatggaattcgtgcgtaaaggcaaaggcctgacgccggaatgggaagaagaaatgaaaaagaacaatgtgccgaactggtatattgattcatgcaaaaaaatcaaatacatgttcccgaaagcccacgccgccgcatacgtgctgatggcggtgcggattgcctattttaaagtgcatcacgcgcttttatattatgctgcgtattttaccgtccgcgcagatgactttgacattgatacaatgattaaaggctcgaccgccatcagagcggtgatggatgatatcagctctaaagggcttgatgcttcgccgaaggagaaaaacctccttaccgtgttagagcttgcgcttgaaatgtgtgagcgcggctattccttccagaaggtcgatctataccgttcgagcgcttcggaatttatcattgacggcaacagtctcatcccgccgttcaactcaattccgggactcggaaccaacgccgctctcaatattgtgaaagcacgggaagaaggggagttcctttcaaaagaggatcttcaaaaacgaggaaaagtgtcaaaaaccattttagagtatttagaccgtcacggctgtcttgagtcgcttccggaccaaaatcagctgtctctgttttaagctttgtgcacagcctccgagcggagtttgatttgcattaaatatatggttatggtatagttttattggaaatgctaacgattaccgaggcaaagagtggggaaacccgctcttttgtattgaacaggcaattttgcctcgacatgtccatcgttttctcaatgcccctgctcttttgaagcagggtttttatgcagaggaacggctgatatgatatcgacagcacaaggaggaaaaacatgagcaaaaaagtgactgataccgttcaaggaatggctcagcccatactggatgaccttcagcttgaactcgtagacattgaatttgtcaaagagggtcaaaactggttccttcgcgtgtttattgattccgataacggtgttgatattgaggagtgcgccaaagtcagcgaagcgttaagcgaaaagctggatgaggccgatccgatcactcagaactactttcttgaagtatcttctcctggagccgagcgtccattaaagaaaaaagccgacttcgaaaaatcactgggcaaaaatgtgtacatgaaaacgtacgaaccgattgacggtttaaaagtgtttgaaggcaaattggctgaatttgatggacaaactgttacaatagagatgacggtcaaaacaagaaagaaacgggtcaatattccgtatgaaaaaatagctaacgcaagattagctgtaacattttaatgaatgaagtattagtgtttaaggggggagaccgctaacatgagcagtgaactattagatgctctcactattcttgaaaaagaaaaaggcatcagtaaagacattatcatcgaagcaattgaagctgccttaatttccgcgtataagcgaaattttaaccaggcgcaaaacgtacgggtcgatctgaaccgtgagacgggcacgattcgcgtgttcgcaagaaaggatgtcgtagacgaggtatacgattcaagacttgaaatctcgcttgacgacgcccagcacatccatccgaactaccttgtcggagatgtcgttgaaatagaagtaacgccgaaagacttcggccgcattgctgcgcagacggcgaaacaagtggtgacgcagcgtgtccgtgaagctgagcgcggcgtgatttactcagaatttatcgatcgtgaagaagacatcatgacgggaattgtacagcgcttagacagcaagtttatttacgtgtctctcggcaagattgaagcgctgctgcccgtcaatgaacaaatgccgaatgagagctataaaccgcacgatcggattaaagtatttatcacaaaagtcgaaaaaacgacaaaagggccgcagatctatgtatcaagaacgcatcctggtctgttgaagcgtctttttgaaatcgaagtgccggaaatttatgacggaacggtcgaactgaaatccgttgccagagaagcgggcgaccgctctaaaatctccgtccgcactgatgaccctgacgttgatccggtcggttcatgcgtcggtcctaaaggccagcgggtgcaggcgatcgtcaatgaactgaaaggcgaaaaaattgatatcgtcaactggtctgatgatccggttgaatttgttgccaatgcgctcagcccgtctaaagtactggatgtcatcgtcagcgaagaagaaaaagccacgactgtcatcgttcctgattaccagctttctctggcaatcggaaaaagagggcaaaacgcccgcttagccgcgaaactgacaggctggaaaatcgatatcaaaagtgaaacggatgcaagagaccttggcatctatccgagagagcatgaagaagatgacgatttagagccgctctttatggagcctgaaacagccgaatcggatgaataagaggtgactttaggtgaataagcgaaaaaaaattcctctgcgcaaatgcgtggtaacgggggaaatgaagcctaaaaaggaactgatccgaattgtccgttctaaagaaggagagatttcagtcgatccgaccggaaagaagaacgggcggggtgcctatatcacccttgagaaagaatgcatcttagctgcgaaaaagaaaaacacattgcaaaatcaatttcaatcacaaatcgatgaccagattttcgaagaattgctggaactggcggaaaaggtgaaaaaataacatgtctggaatggaatggtttcccttgctgggtctggccaatcgagctcgtaaggtcgtgtcgggcgaggacttggttataaaagaaattagaaatgcgcgtgcaaaacttgttctgctgacagaagatgcatctgcgaatactgcaaaaaaagtatccgataaatgcaattattataaagtgccttataaaaaagtcgaaagccgcgcggatctcggccgctctatcggcaaggaatcacgtgtcgttgtcgccgtcactgaccaaggttttgcgaataagctgatcagcttgctcgattaatatttttgggggtgaacgaatggctaaaatgagagtttacgaatatgcaaaagccatcaatgtttcaagcaaggaaattttgactgcgctgaaaaacatggatatagtagtaaataaccatatggcaatgcttgaagaaaagaccattaagcagcttgatgcgaaatttaaaaaaggcggcgccggcgttacatctcagaagcctgcggaaacgaacaaaaacaagccgcaagggattaatcagcagcctgctgggaatcaaccaaacaaaattcgagacggaaagaagaatgacgtgcagaataatcaatttaacaaaaacaagaagaataacaacaacaacaaaaacaaaaacaaacgcaatcataacaacaaaaatcagtatcagcaaaaaccgctgaagccgaaaaaagagcttcctgagaaaattacgttttccggctctttaacagtcggggccttagccgaagaacttggcaaagaaccgtctgaactcattaaaaaactgatgcttctgggtgtaatggctaccattaaccaggagcttgacaaagacacaatcgaactgatcgcatctgaatacggtgtggaaacagaagaagtgattgtgcttgaagaaactgagcttgaaaaatatgaagaggctgacaaagaagaagatcttcaaatccgtccgcctgtcgtgacgatcatgggccacgttgaccacgggaaaacgaccctccttgacagcatcagaaaaacaaaggttgttgaaggtgaagccggcggaatcacccagcatatcggggcgtaccagatcgaagaaaacggcaaaaaaatcacgttcttagatactccgggacacgcggcgttcacaacaatgcgtgcgcgcggtgcggaagtaactgatattaccattttagtcgtagcggctgatgacggcgttatgccgcaaacagtcgaagccatcaaccatgcgaaagcggctgaggttccgattatcgttgccgtgaataaagtggataaagaaagcgcgaaccctgaccgtgtcatgcaggagctgactgaatacggactcgttcctgaagcatggggaggagaaacgattttcgttcctctgtctgctcttacaggcaagggaattgacgagcttgtcgaaatgattctgcttgtcagtgaagtggaagagctgaaagccaatccgaaccgtcaggcaaaaggaacggttattgaagctgagctcgataaaggaagaggatctgtcgcaacacttctcgttcaaacgggaacattgcatgtcggagatccgatcgttgtcggaaatacattcggccgcgtgcgggccatggtcaatgatctcggccgccgcgtgaaaacagccggaccgtccacacctgtagaaatcacgggcttaaacgacgtaccgcaggctggcgatcaattcctcgtctttaaagatgaaaaaacagcccgttctgtcggtgaagcacgcgcttccaagcaactggaagaacagcgcagcgacaaagcgaagctgagcctcgatgatctgtttgaacaaattaaacaaggcgatgttaaagacatcaatttaatcgtaaaagctgacgttcaaggttcagccgaagcgttaacagccgctcttcaaaaaattgaagtagaaggcgtaaaagtgaaaatcattcacacaggcgtcggtgcgattacggaatcagacatcattctcgcatcagcttcaaatgcaatcgttatcgggtttaatgtgcgcccagacggaaatgctaagagcacggctgaagctgaaaatgtagatatccgtcttcaccgtatcatttacaaagtcatcgaagaaattgaagcggcgatgaaaggaatgcttgatcctgaatacgaagaaaaagtcatcggtcaggttgaagtgcgccaaacattcaaagtgtcgaaaatcggcacgattgccggcggatatgtaacagacggccacattacacgtgacagcggactccgcctgatccgtgacggcgtggtcatcttcgaaggggaagtagacgttctgaaacgcttcaaagatgatgtgaaagaagtttcacaaggatatgaatgtggtataacgattaagaaatacaatgacattcgcgaaggcgacgtccttgaagcgtatgtcatgcaggaaatcgaaagaaagtgatcggatttgcggaatgtgaatgcatcatttatgatgcgggatcattaaaggagaaacgagccgttctgaagcggattataacgagggttcagaataagttcaacgtgtcggccgcagaaatcggctatcaggacacttggcagcggaccagcttcggaatcgctgtcgtctcttcctctcacgttcaggcggaaaaggagatccagcgcgtactcgcgtttattgactcctttcccgagatagaacggacgatcactagaacagagtggttttaacttagaggtgattgaattgagtatgagagcaaaccgtgtcggcgagcagatgaaaaaagagctcggggatattatcagccgaaagctgaaagacccgagaatcggatttctcactgtaacagacgtacgtgtttcaggtgatttgcaaatagcgaaggtgtatatctccgttctcggcggagagaaaaagaaagaagaggcgctgaaagggcttgagaaagcgaaaggatttatccgttccgaaatcggcagccgaatcagactccgcaaaacgcctgagcttgaatttgaatttgatgaatcaattgagtacggcaatcgtattgaaacattgattcacgaactgcattcagataaaccgtctgaataacgggaaagaggatgggcgagtgtcgtctgtcctcttttctgcgttttacgggatacaattgataacaaaggagcgaaagacagatggttaacggagttctccttttacataaaccggtcggcatgacttctcacgactgtgtaatgaaaataagaaaactgttaaaaacaaagaaagtcgggcatacgggaacccttgatccggaagtgtcaggcgtactgccgatctgtgtcggacgggctacaaagatcgttgagtacgtcaccgacaagtcaaaaacgtacgatgctgagatcactctcggtttctccacatcgaccgaagatcagacgggagaaacggtcagcgtaaagcctgtcagggagccgctggaagaagcggatatcaaagccgttttagacgaattgaagggaccgcaggagcaagtgccgccgatgtattccgcggtaaaggtcaacgggaaaaagctctatgaatacgccagagcgggtattgaagtggagcggccgaagcggaatatcacgattgaagatatcgcgctcacttcccctgtcacttataacgaagacacagcatcattccgctttacagtcacgtgctcaaaaggcacttacgtcagaacgttggcggtgacaatcggtgaaaaactcggctatcccgcgcatatgtcgcatctcatccgcactgcttccggcgatttcagccttgatgagtgtttcacgtttgaggaacttgaacagcaggtttcggacggaacggttgcagagcatgccgtgccgatcgatagagcgctcaatcatttgccgaaatgggtcataagtgatacattagctaagaaagctgaaaacgggtcagtgtttgacatcccggcggaattttctgcaatgacagctgacgcccgtatagcggtctgtactgaagacggagaatgtgtggccatttatatgccgcatccttcaaaaaaaggactgctgaaaccggctaaagtgctcatgcaaaaaagcgaacaataagaaaaaaggtgaccgttctgtgaagacgatacatatttctcatccgcatcatttacaaaaagaagagcagccggcgtctgtcatggcgctcggctactttgacggcgttcatttgggacaccggaaagtaatcggaacagccagacaaattgccgaagaaaaaggcctgtcgctggccgttatgacgtttcatccccacccttcccatgtgttgggcagggacaaagagccaaaggatctgattacgccgcttgaagataaaatcagccagatcggacgtttaggcgctgatgtgctgtatgtcgtaaagtttgatgaagcgtttgcgtctctgtctccaaaacagtttgccgaggagtatattttagggttgaacgcgcggcacgctgtgggaggcttcgattttacgtacggaaaatacggaaaaggcacgatggagacgctgccggacgatttaaacggcaaggccggatgcacgactgtcgagaaacagaccgagcaggacagaaagatcagctccacttatatccggtcagcgctccaggatggtgacgttgaacttgcgcacactcttctcggccagccgtattttctccggggcactgtgattcacggagacaagagaggccgcaccatcggttttccgaccgcgaatgtcggcctgcacaacagctatatcgtgccgccgacaggcgtgtatgcagtgaaagccgaaataaaaggcgaggtgtatgaaggcgtctgcaacatcggctacaaaccgaccttttatgaaaagcgtcccgatcagccgtcaattgaagttcatttgtttaattttcaacaggatgtatacggagaagacgttaaaatcgagtggtacaaacgaatccgaagcgaacggaagtttaacggcatcgatgaactgacggctcagatcgggaaagacaaacaagaagcgatccgttttttcagcaaataacggaaaaaacatcaaaagtacacaaattttattctaaaagatttgcatatgggcgcgatttttagtatcatatgtttcgtagtcttaaaaccattgcttggcaatccgaagtcaccgacggttgctaggtaactggggctaattatgatatggaggtgaaacaggatggcaattactcaagagcgtaaaaatcaactcatcagcgagttcaaaacacacgaatctgatactggttctccagaagttcagatcgctatcctaacagactcaattaacaacttgaacgagcatttgcgtactcacaagaaagatcaccactcacgtcgcggtcttcttaaaatggtaggtaaacgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaaaaaataataataaaaaaacaatgaaatccttttacatactactttgacattgatatgttcaattcatttcgttcataataggagtaattgattatttcacacattaagagaggagctcgtaatcgaatgggacaagagaaacatgtctttaccatagattgggccggcagacagcttacagtagaagccggccagcttgccaaacaggcaaacggcgctgtcatggtccgctacggcgatactgcagtgctcagcacagcaaccgcatcaaaagaaccgaaaccgctagattttttcccgcttaccgttaactatgaagaaagattatacgcagtaggtaaaattccgggcggttttattaaaagagaaggccgtccaagtgaaaaggccgttttagccagccgtctgatcgaccgtccgatccgcccgcttttcgcagacggattccgtaacgaagtacaggtcatcagcattgtcatgagtgttgatcaggactgctcatctgaaatggctgcaatgttcggttcatcactcgctctttgcgtttccgatatcccgtttgaaggcccgatcgcgggtgtgacggtaggccgcattgacgggaaattcgtcatcaatccgacggttgaccagcttgaaaaaagtgatatcaacctcatcgttgcaggcacaaaagatgccatcaacatggtggaagccggagcggatgaagttcctgaagaaatcatgcttgaggcgattatgttcggtcacgaagaaatcaagcgcctgatcgcattccaagaagaaatcgtcgcagcagtcggcaaagagaaaacagagatcgaactgtatgaaattgacgaagagctcagcgcaaaagtaaaaagccttgcggagccggatcttctcagcgccattcaggttcacgaaaaacatgctcgcgaagacgcgatcaatgaagtgaaaaatgcagttgtcgcgaaattcgaagaagaagagcatgatgaagatacaattaaaaaagtgaaacagacactgtctaaactcgtgaaaaacgaagtgcgccgtttgatcacagaagaaaaagtccgtccggacggccgcggcgttgatcaaatccgcccgctttcttcagaagtcggtcttctgccgagaacgcacggatccgggctgtttacgagaggacagacgcaggcgctcagcgtttgtacattaggcgcccttggagacgttcagattcttgacggtttaggcgtggaagagtcaaaacgctttatgcatcattataacttcccgcagttcagcgtaggggagacaggcccgatgcgcggaccgggacgccgtgagatcggtcacggtgctcttggagagcgtgcgcttgagccggtcattccgaatgaaaaagacttcccgtatacggtccgcctcgtatctgaagtgcttgaatcaaacggttccacttcacaggccagcatctgcgcaagtacgcttgccatgatggacgcaggtgttccgattaaagcccctgttgcaggtatcgcgatgggacttgtgaaatcaggcgagtactatacagtattgacggatattcaagggatggaagacgccctcggtgacatggactttaaagtagccggcacggaaaaaggcgtgacagcgctgcaaatggacattaaaattgaaggcctttcaagagaaattcttgaagaagcgcttcagcaggcgaaaaaaggaagaatggaaatcttggacagcatgctcagcacgcttggtgaatcaagaaaagaactttctcaatatgcgccgaaaattttaacgatgaccattaatccggataaaatccgtgacgttatcggaccgagcggtaaacaaatcaacaaaatcattgaagataccggtgttaaaattgacattgaacaagacggcaccatctttatttcttctactgatgaaagcagcaaccaaaaagcgaaaaaaatcatcgaagatcttgtcagagaagtcgaagtcggccagctttacctcggtaaagtgaaacggattgagaaatttggcgctttcgttgaaatcttcagcggaaaagacggtctcgttcacatctctgaactagcgctcgaacgggtcggcaaggttgaggatgttgtgaaaatcggtgacgaaatccttgtgaaggtaactgaaattgacaaacagggacgagtgaatctgtcgcgtaaagcagtgctgcgcgaagagaaagaaaaagaacaggaacaacaacaatcttaaatgaaaacctaacaaggagcctgggagacccggcttctttattttgagaaagacaacagacgggttctaccttgtcctcctcatacataatgtgtgatgagggggaaggacatgttgaaaaaattcgtgccgtttgccgtttttttatttcttttttttgtttcgtttgaaatgttaaaaaacccgtatacagttgattacatagacgcaatgaaaaaagacgcggtaactgtgtcatcatcaaaagatccgctctatgaagaattactgcaaaaagcgtcagagtatgaagtgaagccgcaagacgctcggattgataaaatatggaagagtataccgggatataacggtttaaaagtcaatgtggaaaaatcctataaacaaatgaaaaaggacggagaatttcacgaagacgaccttgtctatgagcaggtaaagccgaaagtccatcttgattctctcgcgcccgaacccatttataaaggaaatcccgacaaaccgatggtcgctttcctgataaatgtcgcctggggaaatgaatacgtggagcaaatgctgcctattctgaagcagcaccaggtcaaagcaactttctttcttgaagggaaatggctgaaaaacaatcaggaactggggaaaaaaatagcggcagacggacatgaaatcggaaatcattcatacaatcaccctgatatgagcaaactgacttcaggaagcatttccgaacagctcgacaaaaccaatgcacaaatcagcgagacgctcggcatgaagccgaaatggtttgcgccgccaagcggcagcttcagaaaagccgtggtcgaccttgcggcggaaaaaggaatgggcaccatcatgtggaccgttgacaccattgactggcaaaaaccgtctcccgctgttttacaaacaagggtgctgagcaaaatacataacggagccatgattttaatgcatccgactgatccgactgcgaaaagcctggatacactgattgcaaaaatcaaagaaaaaggctacgcgctcggctcagtgtctgacttaatggatgaaaacaggctgatgaagtagcaggcagctgcctgtctttgaataggaggaacagacttgataaaacgctatacatgccaaaacggtgtaagagttgtgcttgaaaataatccaacggtgcggtctgtggcaatcggcgtatggatcgggacgggatcacgtcatgaaacgccggagacaaacggtatttcgcactttcttgagcatatgttttttaaaggaacaaataccaggtccgcacgtgaaatcgcagaatccttcgatcggataggcggccaagtgaatgccttcacttcaaaagaatatacgtgctattacgccaaagtgctggatgagcatgcaaactacgcacttgatgtgctggctgatatgttctttcattctgcttttgacgaagatgagctcaaaaaagaaaagaacgtcgtatatgaagaaatcaaaatgtatgaagacgcaccggatgacattgtccacgatctgctgagcaaagcgacatacggcaatcattcgctcggatacccgattctcgggacggaggaaacgctttcgtcgtttaacggcgattctctcagacagcatatggatgacttttacacgccggaccgcgtcgtcatttctgtcgccggaaatgtaacggaacaattcattaaagacgtggagaaatggttcggtacatacgaagcgaagggcaaagcaagcggcatcagcgagcctgagtttcattatgaaaagctgacgagaaaaaaagacaccgaacaggcgcatctctgtctcggtttcaaaggcctgaaagtcggagatccggacatttacgatttgatcgtcttaaacaacgtgcttggcggaagcatgagcagccgtcttttccaggatgtgcgcgaagataaaggactggcctattctgtatacagctatcacagttcctatgaagacagcggtatgctgacgatttacggaggcaccggcgcgaatcagctcggacttctgtctgaaaccattcaggaaacgttatcggttctaaaacgtgacggtatcaccccgaaagagctggaaaacagcaaagagcaaatgaaggggagcttaatgctcagcttagaaagcacaaacagcaaaatgagccggaacgggaaaaatgaactcctgctcggaaagcataagaccatggatgaaattatcgctgaattaaatgcggtcagcctggaaagcgtcaacggcctcagccgccgcttatttacggatgattacgcactatcgctcatcagcccgaccggcaatataccggcctcgtcttaagctgcaaagcagtctgcctctgtacggggcaggcatttttttttgctccgggtcatatagtacaaggggtggctatcatgaggctcagtgaactgtcaggtaaagaaattgtggatattaaacgggcagagcggctcggcgtgctcggccagaccgatttggaaattaatgaacaggacggacaaattaccgcgctgttgataccgacggtaaaatggttcggactgcgaaaacaaggccacgacatccgcgtcccctggaaccatatccaaaaaatcgggtcagacatgatcattttagacgttccgggggagatcacgcctcccgaagagtagatcttattcattttttgcaagcaccggctcatacagccggtgctttttttatgaaaaagacgctgtacattcaccgccctttctctttgcacatacgatgaagaggaggatgacacttaaaggatccagtaactgtaaagaaggtgaacgtttcagatgttaaccggattaacaattgcgatcattggcggtgacgcaagacagcttgagattataagaaagctgacagaacagcatgccgatatttatcttgcagggtttgaccaattggatgacggttttacaggaaccgtcaaatgcaaaattgatgagattccctttcaaaaaatagacagtatcatcctgcctgtatcggcaacgaccggagaaggcgttgtttccacggttttttcaaatgaagaagtggtattaaagcagagctatcttgagcggacaccggagcattgcgtcatttattcaggcatctccaacgcgtatcttgaggggatcgccagcgaagccggccgtaagcttgtgaaattatttgagcgggacgacatcgcgatattcaactcgattcccactgttgaaggaacaatcatgatggcgattcagcatacggattataccattcacggatcaaatgtcgccgttcttggcatggggcgcaccggtatgacgatcgcccggacgtttgcagcgttaggggcgaaagtaaaagtgggcgcgcggagttcggctcatttagcccgtatatcggaaatggggctttctccttttcaacttgaagagcttactgatcatgtaaatgatattgatatctgcattaacaccgtaccgagcttgattctgaatcaaagcgttttatcgcgcatgacgcccaagaccttgattttggatttagcatcccgtccgggcggaacggatttcaaatatgctgaaaaacaaggcattaaagcgctgcttgctccgggtcttccgggaattgtggccccgaaaacagccggacagattattgcgaacgtattgagcaagcttttggcagacttaaagaaagaggggaaataaccatgtctctgaaagggaaaagaatcggattcggattaaccggctcgcattgcacatatgaggaagtgtttccgcaaatagaggcgcttatcagtcaaggagctgaagtccggccggtcgtgacatcaaccgttcaatcgaccgatacccgctttggggaggggggagattgggtcagaaaaattgaagaaacaacaggctttgaggcgattgattccatcgtaaaagcggagccactcgggccgaaacttccgctcgactgcatggtcatcgcccctttaaccggaaattcaatgagcaaactcgcaaatgcgatgaccgacagccccgtccttatggctgcgaaagccacgatccgcaacggccgcccggtcgtgctcggaatttcgacaaatgacggactcggtttaaacggaacgaatttaatgaggctgatgtccgcaaaaaacatatatttcatcccgttcggccaggatgaccacgtgaaaaaaccgacatcgctcgtcgccagaatggatctccttccgattacggtagaaaaagctcttttgcaccagcaggttcagccggtgctcgtacaccatcatgaataaaaaatcatgatgacagaaaatcattccggaataaaaaaattcggtcaatccgtgactattctatggtaaaataaaacgtaaaatgcaaagtcaattcaacaaatgatgcttaattggcggaaggagttttacagatgggaagaggattacacgtagcagttgtcggagcgacgggagccgtaggacagcaaatgctgaaaacactggaagacagaaactttgaaatcgaaacactcacactactatcctcaaagcgttctgctggtacgaaagtaacgtttaaaggcgaagaatatacagtgcaggaagctgttcctgaaagcttcgaaggcgttcatatcgcgttattcagcgccggcggaagcgtatcacaaagcttggcgcctgaggctgtaaaacggggagccatcgtgattgacaatacgagcgcattccgtatggacgaaaatacaccgctcgtggtgcctgaggtgaacgaaggtgatctgcacaaacataacggcattatcgccaaccctaactgttcaacgattcagatggtggctgcgcttgaaccgatccgcaaagcgtacggtttgaaaaaagtcattgtatctacttaccaagctgtgtccggagccggcaatgaagcggcgaaagaattgtacagccagacaaaggcgattttaaacaatgaacccgcagaaccgtccattatgccggttaaaggcgacaaaaagcattatcaaatcgcatttaacgccattccgcaaattgataaattccaagacaacggctatacgtttgaggaaatgaaaatgattaatgaaacgaaaaaaatcatgcatatgccgaagctggaagtggctgcgacatgtgtaagactgccgattgaaacagggcattcagaatctgtttacattgagcttgaccgtgatgacgcaaccgttgaagatattaaacagcttttaaaagaagctccgggtgttacgcttcaggatgatccggcggagcagctttacccgatgcctgctgattgcgtcggcaaacgcgatgtatttgtaggaagaattcggaaagatttggacagagcaaacggttttcatttgtgggttgtttctgataacctgttaaaaggcgccgcttggaactcagttcaaatcgcggaaagcctgcaaaaactgaacctcgtataaaacaaacgtattttctataggcgaacagaagagagtaaggctctgcctgctctcttctgttacgtcagactaatttggagtgaaaatagtgaagatcattgttcaaaaattcggcggaacatccgtaaaagatgacaaaggccgcaagcttgcgctagcacacataaaagatgccataagtgaaggttataaggttgtcgttgttgtatcggcgatgggaagaaaaggagacccgtacgcgacagattctttaatcgggctcctttacggcagccagtccgacatttctccgagagagcaggatatgcttctgtcttgcggagaaacgatttcgtccgttgttttttccagcatgctgaaggaaaacggcataaaagccgcagctttaacaggagctcaggccggctttttaaccaatgcccagcatactgacgccaaaattatagaaatgaaaacagagcggcttttcgctgcactcgccagccatgatgccgtcgttgtcgcaggctttcagggagcgactgaaaaaggcgacacgacgacgatcggcagaggtggaagcgatacatcagcggcggcgctcggcgcggcggttgatgctgagtttatcgacatttttacggacgtggaaggtgttatgacagccgatccgagaatcgtggaaaatgctaagccgcttccgaatgtcacatatacggaaatctgcaaccttgcttatcaaggcgcgaaagtcattcatccgcgcgcggtggaaatcgccatgcaggcaaaggtgccgatccgcgtgcgctccacttattcaaaagacaaaggcactttggtgacgtcccatcattcgtctaacatcggcagcgatgtattcgaacggctgattacggggatcgcccatgtgaaagacgtgacgcaatttaaggttcccgccaaaatggggcaatacaacgttcagactgaagtctttaaagcaatggcaaatgccggaatcagtgtagatttctttaacattacgccgagtgaaatcgtatataccgtagccggcagtaaaacggaagccgcgcgcagcattttggctgaattaggatatgagccgacagtgacggaaagctgtgcgaaagtgtcagcggtcggcgccggaataatgggtgttccgggtgtcacgtcaaaaatcgtctccgcactttctgataaaggcattccgattctgcaatctgccgacagccatacgacgatctgggtgctcgttcatgaaaaagatatggtaacggccgtaaatgcgctgcatgaagtgtttgaactttcaaagtaaatgtgattgaatcatgatgaggtgaaaaaaatgaatgtcggaaatatatctacagcgatgattaccccctttgacagtaaagggaatgtagactttcaaaaactgtctacattaatcgactatttgttgaaaaacggcacggattctttagtcgtcgcaggcacgaccggcgaatccccgacactttcaacggaagaaaaaattgcactctttgaatttacagtcaaagaagtgaacggacgcgtgcctgttattgcgggtacgggaagcaacaatacgaaagattccattaaactgacaaaaaaagctgaagaagccggcgtcgattgcgttatgcttgtcacgccgtattataataagccttcccaagaggggatgtaccgtcattttaaagccatagctgaagaaacgtctcttcctgtgatgctttacaacgtgccgggcagaacggtcgcttcgcttgcgccggaaacggccatcagacttgcggagattccgaatatctctgcgattaaagaagcgagcggcgatcttgatgccattacgaaaatcattgccgaaacgccggaagatttttacgtctattcaggtgatgacgggttaacgcttcctattcttgcagtcggcggaagaggagtcgtgtcagtggccagccatattgtgggttctgacatgcagcagatgattaaaaactatacgaacgggcagacggcaaccgcggcactgattcatcagaagcttctgccgatcatgaaggagctctttaaagcgcctaatccggctccggtcaaaacggcgctgcagctgaaaggccttgatgtcggatctgtgcgtcttcctcttatcccgctgaatgaagatgaacgtctgagcctgagcagcgtcatcagcgaactgtaagaaaaaatttatacagttgaaatacgcggtcattctcatttttatcgtgagtttgaccgttttgtatacatattggttttccctaaaccttccgcttcttcttgttttctaaaattgatatcagttataataggaacaagtgatgatggacgggtatgagactaggaggatacagattttgaaaaagaaaaatacagaaaacgtcagaattatcgcccttggcggcgtcggagaaattgggaagaacctatatgtcattgaaattgactcagacatatttgtagtggatgcggggctgatgcaccctgaaaatgaaatgctcggtattgatgtcgtcattccggatatttcctacttagtagaacgggctgaccgcgtgaaggccatctttctgacacacgggcacgatgaaaacatcgggggcgtcttttatttattgaacaagctgtcggtgccggtatacggaacgaagcttacgcttgcattactgagagaaaaactcaagcagtacgggcataatcgaaaagctgatttacgtgaagttcactctaaatcagtcattacatttgaatcaacgaaagtatcgttctttaaaacgattcacagtattccggattcagtgggagtcagcttcaaaacatcacttggctctattgtatgcacgggagacttcaaatttgaccagacgcctgcttatcatcaatcatgtgatattggcgaaattgccaaaatcggaaacagcggcgtgctcgccctgctttctgacagcgccaatgcggagcgcccggggtatactccgtcagaagcatatgtaagcggtgaaatttccgatgcgatgaacaattcagaaaaccgtgtcatcattgctgtattcgcgtctaatatcaaccggattcagcaagtgatacaggctgccgtccagaacggccgcaaacttgcaatcgccggaaaaaatctgcaaaacgtgcttcagcttggacgcaagctcggctatattgaagccgaagatgaaatgtttattcctgtgcaggatgtgaaaaaatatccgaagcgggacgtggcaattgttacagccggaagccatggtgagccgctggccgctcttacgcgaatggccaagcaggcgcacaagcagcttaacattgaagaaggagacaccgttgtcattgcatcaacaccgattccggggcatgaattgatatattccaaaaccgtcaacctgcttgcccgcgccggcgctcaagtcattttcgcccaaaaacgagtgcatgtgtccggtcacggttcgcaggaagaattgaaactcatgcttaatttgctgaaaccgaaatatttaattccggttaacggtgaattcagaatgcaaaaagcgcattccaaaatcgcagaagagatcggcatgaaacgcagcgacattttcttgattgaaaaaggtgatgtcgttgaattccgcggccagaatgtgaaaatcggggataaagtcacatacggaaacgttctgattgacggcctcggagtcggcgacatcggcaacatcgtgctgagagaccgccgcttattgtcacaagacggcattctcatcgtcgtgatttcactcgataagcagaagaagaaccttgtttcaggccctgagatcattacgcgcggtttcgtgtatgtcagagaatcagaggggttaattgtacaagctactgagctcgtccgctctatcgtgactgaagcgacggaaacatctgccgtagaatggtccacgctgaaacaagcaatgcgtgatgcgctgaatcaattcctttatgaaaaaacaaaacgcaagccgatgatcattccgatcattatggaagtataatgtatacaaagccggagcgcatgatgctccggctttgtttttgttcatgtcccggatggaaatcatcatctttgttcataatacaaagagacattcggaaagggtgaaagataaaatggatcatcgtatggaaaacaccgaagaacagcagcccgaaaaatcagatgcgaaagacagcattatgagcaaaattcagcagctgggagagacatctctgccgcaaatgtcccaagataccaatattcactgcctgacgatcatcggccaaattgaggggcacgtccagctcccgccgcaaaataaaacaaccaaatatgaacatgtcattccgcaaatcgtcgccattgagcaaaatccgaaaatcgaaggacttctgatcatcttaaacaccgtcggaggcgatgtggaagcggggcttgcgattgcggaaatgctcgcatccttatcaaaaccgaccgtctcaatcgtactcggcgggggccactccataggtgtgccgatcgccgtgtcatgtgatcatagttttatcgcggagacagcgacaatgaccattcaccccgttcggcttacaggtctggttatcggcgttccgcaaacgtttgaatacctggataaaatgcaggagcgggtcgtcaactttgtgacccatcattcaaatatttccgaagaaaaattcaaagagctgatgttttcaaaaggaaacttaaccagggacatcggaacgaacgtagtcggcaaagatgcggctgattacggattaattgatgccgtgggcggcgtcggacaggcgataaaaaagctgaatcagctgattgaggaacgaaagggcgaggaaggaaggatgattcaatgatcctttataccgtcatgccacaagaagtcgtttacggtcaggatatagagcaaagcgtgcatgaacaggtagattacgccggcgtgccgctgctggttgagatgaagggaaatgaagctgaagtcgtacagattttaagtacgaacccgatggattttctgaatccggacatcgctccgggacaaaaaatcaagctgaaaatctaaccggcattcagtccgtttctcgggggcaaaatatgctataataggggaatcctacagaaaaatgcagccggcaaaaggctgcttttcttcatgatgtatgattttacattttttaacgcagtaaggtgatgagtgtggcaaagaaaaaacggaaatctaaaaagaaacaagagagtaagctcaatctaaaatacgaactaagcggactgctctgtgttgcaatctcgattattgctgttttgcagctcggcgttgtgggacagacatttgtgtacttgttccgtttttttgccggagagtggtttattttatgcttaattgcgctcttccttctcggaatttcgctgttttggaaaaagaagagtccaagccttttaacgaggagaaaggcagggttgtactgtattatcgccagtattttgctgctgtctcacgtgcagctctttaaaaatctgtctcatcacgggtcgattcggtcggcaagtgtcatcggcaacacgtgggagctgtttatgattgacatgaaacagcaggctgcttcccctgatttgggcggcggcatgatcggcgcggtgctgtttgcagcttcccactttttatttgcatcaacgggttcacagatcatggcgatcgtgctgatcttaatggggctgattcttgtaacggggcgttcactgcaggaaacgctcaaaaagtggacgagccccgtcggccggtttatccgcggtcaatggcaggcatttcttgaggatatgaaaacggtcagaacgaatatgtcttcgccgaaaacaaaaaccaaatcgggcaaaaaacaaaaacgggttcagaagaaaaaagaaatgcctgagcccgaagaagaggatgaggaaatcatttcgccgatcatccattcagagccgattatttcaagcttttcagaccgtcaggaagaacgcgtcgaaccgctgattccggaaaaaacgcaggagacggcgcaaacggcaaaagatgagccttccggcggcgctcaagacagtgacgaaacggctgcggctccgccgatgacgtttacagagcttgaaaataaagattatcaaatgccttcattggacatcctggctgacccgaaacataccggccagcagaccgataagaaaaacatttacgagaatgcaagaaaactcgaacggacctttcaaagcttcggggtaaaggcgaaagtgacccaagttcatctcggcccggcggtcacaaaatatgaggtgtatccggacgtcggggtcaaagtcagtaaaatcgtgaatctgagcgatgacctcgcgctcgcgcttgccgccaaggatatccggatagaagcgccgattccgggcaaatcagcaatcggcatcgaggtgcccaatgctgaagttgcgatggtttcgttaaaagaagtgcttgaatccaagctcaatgacaagccggacgcgaagcttctgatcggcttgggacgaaatatttccggggaagccgtgcttgccgaactgaacaaaatgccccacctgctcgtagcgggggcaacgggaagcggaaaaagcgtctgtgtcaacggtattattacgagcattctgatgagggccaaaccgcatgaagtgaagatgatgatgattgacccgaaaatggttgagctgaatgtgtataacggcattcctcatctgcttgcgccggtcgtgacagatccgaaaaaggcctcgcaggctttgaaaaaggtcgtcaatgagatggagcgccgctatgagctgttctcccatacgggtacgagaaatatagaaggctataacgaccatattaagcggtcaaatgccgaagaagaagtcaagcagcctgagctgccgtacatcgtcgtcattgttgacgagcttgccgatctgatgatggtcgcttcttccgacgtggaagattcaattacgagactttcacagatggcgcgggcggcgggaattcatttgattatcgcgacacagcggccttcagtcgatgtcattaccggtgttattaaagccaacattccgtcaagaattgccttcagcgtctcatctcagaccgattcacggaccattttagacatgggcggcgctgaaaagcttctggggcgcggagacatgctgtttctgcctgtaggcgcgaataagcctgtccgggtccagggagcatttttatcggatgaagaggttgagcatgtcgtcgatcatgtgattacgcagcaaaaagcgcagtatcaagaagagatgattccggaagaagtgtcggaaacacacagtgaagtaacggatgatctctatgacgaagcggtcgatttgattatcggcatgcagacggcatcagtctccatgcttcaaaggcggttcagaatcggatatacgagagctgcccgtctgattgacgcaatggaggaacggggcgtcgtcgggccgtatgaaggaagcaaaccgagggaagtactattatctaaggaacaatatgatgagctctcttcttaaaaaggagagagttttcactgaaaatgatatcaccaaaatcattcctatttatttttttattaaaacatgatatagttgtcccaattgttcaataatttatgaaagtggtttacggaggggaaacatgtctacaaaagctgacaatcgtcacttgtacctaaaagtgattgagcgaatcaaagaggatatacaaaacggaatttacaccgaaaaggaaaagcttccttctgaatttgagctttcaaaatctatgggtgtcagccgggcaactctgcgtgaagctttgcgtatccttgaagaggagcatgtgattatcagaaggcacggtgtgggcactttcgtccatacaaaaccgctgtttctttcaggtattgaacagctcaacagcgtgacgaaaatgattcagcaggcgaacatggtgccgggtacgatttttttgtcgtctcaggtcatcacgccgtctgaggaagatatcgctagattccggcttgagcctgagcaggagcttttttatttggaacgcgtgagaacggcaagcggcactccggtcgtttactgtttagatacgattccgatgcacattctgccgaattctttctgtcatgaacaggaatctatttttgatcttttggaaaaaaactccgggtctgtgatcagctatgccgttgccgatatcgaaccgatcggatatcacgatacgatttcaccggttttggagtgcgagccggagacggcgcttttattgctgaagcaaacccactataatcagaatgatgaacctgtgctgtattcattaaattatttccgggctgataagttcagttttcatgttgtaagaaaacgtttttaagacagacgcgtcatgtgtctgtttttttatttgccgcttcaatacatactttgttttccgcaaggcacaataaaacaggaaacaaccaagtatagtgaatgggtgaataagttgagtaagaagaaaaatggaacaaaaaatatcattgctctggcttctgtaccgctcgtgatgacactcgggaattccatgctgattcctgtgcttccgatgattgaaaagaagctgtccatatcgtcttttcaagtatcgttaattataacggtctattcgattgtggcgattatttgtattccgattgccggatatttgtccgataaattcggaagaaaaaaggttcttctgccttgtcttctcatagccggtgcgggcggagcgcttgccgcgatagcttccaccgcgttcaagcatccttatcccattatcttggcggggcgggtgctgcagggaatcggttcggcaggggcggctcctgtagtgatgccgtttatcggtgatttattcaaaggggatgatgagcggattaccgcggggctcggcgacattgagacgtcaaacacggccgggaaagtattaagcccgattctcgggtcgctcttggctgcatggttttggtttatgccgttttggttcattccgtttttttcgcttatcagtttttttctcgtattgtttttggtggcaaagccggagaaacaaaaagaagccccttctatttccgaatttgtaaaaaatgtcggccgcatatttaagcgtgacggacgctggctctttacggtatttatcatcggctgcgtgattatgtttttgctgttcggggttcttttttatttatcagactcactggagaagaaatacggaattgacggtgtggctaaaggagcgcttttggcaatcccgcttttatttctatccgtcagttcatatatatcaggcagaaaaatcgggaaagaccaaggcaaaatgaagttctgcatcgttttcggaatgagtgccgtgacactgtcgtttatcggcctatggtggaatcacagtttttatttattatttatctttttgtgtgtcagcggtatcggtatcggaatagcattaccggcattagacgctgtcatcacagaaggcgtagacaacgaggaatcgggaaccatcacctcattttataacagcatgcggtttatcggagtagctgcgggaccgccgatctttgctgccctgatgtcaaatgcaggctggctgatttttattttatccgctttttgcggcattgtgtctgtatttttagcgctgttaaatatctcatcacaagcaaaagaaaaaaaggaatcattaaagacggtgtaatctgcactgtctttttttattttattttgaagattgacatgatatcgtcaagtcgttatcctttttaatagttaaacattttaactattggaaggagggggaaaagatgcatgaagaaaaagtaaagcagctgattcagcgttattccgatgtatacctgcacgtcttaaaaaaaattgacagcattatcgctgaaaaagtgaacaaagagctgacattggatcaatattacatactccgctatattatgctcaatccggattgcaaatcaattgaactggccgcggtgtgccacgtcaacaaaagcgccattacatcgatgacgaaccgcctgtatgaaaaaggctacatcaatagagaacgcagccaaagcgaccgccggagcatacttttaaatgtcacggaaaaggggacggaagtatttcaccgtgtggagcggcggattgaggaactcgtccgttcatatattatgtattttgatgaagacgaggcggagatgttcgttaatacatatgaaaaattatatcgattgatgatgacagaggaggatcagcagacataatgaaaaacattatccgagcccgctggatcatcgccgcggtatggatcgccgcaacggtgatatttatgcttacagcgcctgatatggctgaattgacacgggagaaagggcagatttccgtaccggacggatattcctcttcttatgcccatgaattgcttgatgaaatgtctgattcagatgcaccgtcttcttctgccgtcatcgtatttcacgaaaaaggcttaatgacagacaaaaaagatcgtctggaagaagccgtcagcactttgtctgaacagaaaaaagcgcttcagattaaaacggtgacttcatacttcggggagaaaaatgacgacatcaaaaaacagctgctgtcaaaagacagacaaacgatgctcgttcagctgcagcttgatacatccaaaaacgatatcctcgaaatcaaaaataaaattgataaagagctgaaaccgtacggcgtatcatacggcattacaggccagtcgctgatcgatgaagatgtgttaaaaagctcacaggacggattgaaaaagactgaatatataacggtcgcttttatcctgatcgtgctgatccttgtattccggtcagtggtcgctccgtttgtgccgcttttatctgtattgatatcttatttagtcagccagtcgattgtcgcatttttagtcgaccagctgaattttccgctctcaacttttacgcagattttcatggttgcgattatgttcggaatcggcacagactactgcattctgcttctcagcagatttaaagaagaactgtcgcatggcgctgatataagagaggcgatcgtcgtcacctacaaaacggccggaaagacggttttgtacagcggcggtgcggtgctgatcggatttgcctgcatcgggtttgcgacatttaagctgtatcagtcggcagccgccgttgcagtcggtgtcgcggtgctgctgcttgcgctcatgacgatcgtgccgttttttatggctgttttaggaaaaagactgttttggcccgttaagggtgatatttcccatcctcaaagtaaagcatgggaaacggcagggcggttttcatttaaaaggccgctcatcagtcttgcaatcgttgcggtattcaccgtcccgccgatccttctttacaaaggatcgctatcttacaacagccttgacgaaatcggggataaatatgaatccgtccgcgcgtttaatacgatttcagacgcattcggcccgggggagcttcttccggccacagtcgtcatcaaaaatgatgagcctctaaataccgaaaaacacctgattgatatcgaaaaaatcagcagagaacttgaaaaaacagagggtgtaaaaacggtcagaagcgccacgcgccctgccggaaacggattgaatcaattatttgtcacaaatcaggcaaagcagcttcaagaagggcttgataaaggcaatacaggacttgaaaaaatcacggacggattagggcatgccgcaaagtcgttagctgattcacagccgcagatcgaagagtcggggaaaagcgtcaatcagcttattaacggaacattgtctctgaaatccgggctttctgatataggcgaaaacctgaataaactgcaggcaggcgtgaatgagaataaagccggcgtcgcccagatgagaaagcagattgaagagcaaaaacaaatgctgacttcacagctcaaacaaaacagcggtctcgcttcagaaacgcaaaacgctttaaaattggtaaaaaccgtcctgccgatgaaagatgaaaccagcagacagcttgccgatttgaacaagcagcttgcccggctgccgtttgcaaaattggaagcgtcaataccgtcagtcaaaaccgatccctcttacaaagaaatcaaatcggcctttacgggtgtacagtcagccgtttccaaggcaaacgcggatgcagaagcgttttctaaacaggtcgacagtcaaaaggatcatctgcagcaagcggaaaaacaatttgcccggctggcagccgctcaaaaaaagatcgacactcaaattaacgcaatgatcaccggtctgaccagtattgaaaacggtctgcagcaagtgtcagacggacagggggctcttgcaggacaaatgccgcgccttgaatcggcggcaggacagctcgcggagggccagaaaaaaatgaagagcggtctcggtgatttttcttcccggctcagcgatctttcttcaggccttaacgatagtgtaaaagggcttaagaaagtatcaagcggcatgatgggggcgaatgattacctgggtgagcttcacaaggcctcagataaagaaatgacaggctggtttgtgccgaaagacgcgttgacaaacagtgatttcacaagcgtgtttaatacgtacatgtcagatgacagaaaaacgacagaattgaccgtcgttcttgataacaatccttactcaaatacggccattcaagatattcaagcgatcaaagcgagcgtaaaaagagccattccgaacacggatctgaagaatgcctctttcggcgtttcgggagtctccagcatgaatgccgatctgaaagaagtatcggattcagacttcaaacggacggcaatgtttatgctggcgggaatttttctgattctcatcataatgctgcgctctcttattatgcctgtttatttagtggcgtcgctcgtactgacgtatttcgcatccatcggcgtgacggaatacatctttacacacttcttcgggtatccgggcgtaaactgggccgtgccgttcttcggctttgtcattttgatggctcttggtgtggattattccatctttttaatggaccgctttaatgagctgaaaaaagaaggaacggaacccgcaatgatcagcagtatgaaaaatatgggttccgtcatcatttctgcggcgattattttagcgggaacctttgcggccatgctgccgtcaggcgttctttccttattacagattgcaaccgtggtattaacaggccttctcatgtacgcaattgtcgtccttccgttttttgtgccggtcatggtgaaaatattcggaagagccaactggtggcctttcaatttgaaaaaataacgttcaatgcctctgcctgttttcgggcagaggttttttgtttccttataaatcctccagttgatataattacatctgcgcactcttttttgcgaatcctgaaatttggccataatacatactattaaagaatgaacgaaggaggtttcacatgacttacgtaaatgaaatgaagtcaaagcacggcgggatcaccgcccacatcgtaaagactgagaaatttaaaaccgtttcgctgacgtttaaaatgctggctcctttaacgaaagagctcgtaacaaaaagggcgctgtttccgcatgtgcttctgcgcggaacagaaagccgcccgaaaaccgctgatctgcgttcttattttgatgagctgtacggcacatccgtttcagctgatctgacaaaaaagggagaacgtcatgtcattacgttcagacttgagattcctaacgaaaagtatctgaaggaccgcacaccgttattggaaaaaggccttcagcttttatcagagcttgtcttttcgcccgctttggaaaacggcgccttcctgcccctttatgtcacgcaggaaaaacggacgctgaaacagcggattcaagccgtatatgatgataagatgagatattctaatctgcgtctcgttcaggaaatgtgcaaaagcgaaccgtatgcccttcacgtcaacggcgagttcgatgatgtcgaacacattacaccgcaagagttgtatgaagcctatcaaaaagccatacgcgaagatcagctggacctgtacgtcatcggcgatgttgattcagatcaggtgaaaacggccgttgatacgtattttaaaacggaagaacgggagctgcagccttttgaaagaagcaagacgaatgaacagcccgatccgaaggaagtcattgatgaagaggacgtcaagcagggcaagctgaatatcggattccggaccaatacgacatatacagatccggattatccggcattgcaggtgtttaacgggctgttcgggggtttctctcattcaaagctgtttataaatgtccgtgaaaaagcaagcctcgcctattatgcagcctcaagggtggaaagcttcaaagggcttttgatggtcatgtcgggcattgaggtgaaaaattataagcaggccgtcaccattatcgaagaacaatttcaggctatgcaaaacggtgacttttcagaggacgatatcgcccaaacgaaagccgttattaaaaaccaagtgttagaaacgattgatacggcatacggcttagcggaatttctgtatcagcaggcttcagcccaagtggaaataccgatcgaaactttcctcgacaatatcgagaaagtgacaaaagaggacattatcaatgtcggaaagaacattaagctggatacgacttatttcttaaaagggacggggggagcatcttgactaaaccgataaatttcgaacagcttcaggaaacgctgtatcatgaaaaaatggcaaacggccttgatgtctatgtgctgccgaaacagggttttaataaaacatacgccgtgtttacgacaaagtacggttccattgacaatcaattcgttcctttaaataaggaagaaatggtacacgtgcctgacggaatcgcgcattttctggaacataaactgtttgaaaaagcggacggcgacgtgtttcaggacttcagtaagcagggggcgtcggcaaatgcctttacatcatttacacgaaccgcttatctgttctccagcacttctaatgtagagaaaaacctggaaacactcgttgattttgttcaggacccgtatttcacggaaaaatcagttgaaaaagaaaaaggcatcatcggccaggaaatcaatatgtatgatgataatccggattggcggctgtttttcggccttatcgaaaatatgtataaagaccaccccgtaaaaattgacattgccggaacggtggagagcatctctcatattacgaaagatctgctgtatgagtgctacgaaacgttttatcatccgagcaatatgctgctctttatcgtcggccccgcagatcctgaagcgatcatcagccaggtgcggaaaaaccaggagaaaaagccgtttacagaccagcctgaaatcaaacgtaaagaggttcaggagcaggaagcggttttccgccgggagcaggaattaaaaatgaacgtgcaaggctcaaaatgtcttgtcggtttaaaggcgaaagacccttataaaacggggcgggagctgttgaagcacgagctcagcatgaacctcatgcttgaatgtctcttcggaaaaagctcaccgcattacggcaacttgtacgataaaggctacattgatgaaaccttcagctttgattacacggctgaatacggattcggctttgcctctgtcggaggagatacaccagagccggataagctcgctgacgaattaaaacagatgctgcttgatgcagaatcagccgtaactgcggaaaaacttgaccttgcgagaaaaaagaagatcgggtcatttttaaaagcgctcaattcgcctgaatacatcgccaaccaattcacacgctacgcctttttagatatgagtctgtttgatgtcgtaaccgtactggagcagatcaccctggaagacgtaaagcgggtcattaaagaagaaatatcagaagacaggctgacagtctgcaaagtcgtgccaaaatcataacaaaacatccctcacgccctgagggatgtttttctggggaaagaaggagtattgattgatgaaacagacagcgctcgtaaccggagcaagcggcggaatcggacaaagtataagtgaagtcctcgcaaaaaacggatatgacgtccttttgcattatcattctaataaggaagccgcacacaggcttgcggaaaggctgagcgcatcattcggcgtaaaagcctccgctatccaggctgatctgtcctcaccggatggcgcggagacactcagccgttccgttaagcagcctgtggacgctctgatattaaacagcggcaaaagtcatttcggcctgattacggacgttacggatgacacggcgcgggagatggtgcagctgcatgtgacgagtccgtttcttttggcgcgtaatctggtgcccggcatgatccggaaaaaaagcgggggcattgtcgcgatcggttccgtctggggagaaacaggtgcatcgtgcgaggtattatacagcatggtcaaaggagcgcagcattcgttcgtcaaagcgcttgccaaagagctcgctccgagcggcgtccgcgtgaatgcggtctcgccgggtgccgttgatacaaatatgcttgatcagttcacgtctgatgaaaaagaagcgttggcagaggaaattcccgcgggccggctggcgaagccggaggaaatcgccgaagcggcggcctttttattatcggacaaggcttcctatattacggggcatatattatccgtaaacggcggctggcactgctgaaaaaaatgtgtgtatagtttgcatctgcacggacaaaataattttgtaacaacagatgaaatggaggaacccaacatgtcagtattagaaaactgggataattggaagaatttccttggcgacagattgaactatgcgcaggaaaaagggatgagtgatgaaacgatcactgacctcgcgacagaaatcggcggttaccttgcgaacgaagtcgactcgaaaaaccatcaggaaaaagtgcttgctgatctttggagcgttgcttctgaagatgaacagcgcgccatcgcaaatatgatggtgaagcttgttgaaaataacagcactcattaagaggggggatttctcctctctttttttatgttttcctctatagagcaacattcttctttctaattagagaaaaatgttttatgataaaggaaggtaaaaatttgccacaatggagggggtatatcatttggcaaagctcgaatggtattttgaatatgaaattcaagtgaaccgccccggcctgctcggggatatttcatctcttctcgggatgctgtcaattaatattgtcacaattaacggtgtcgacctttccagaaggggaatgctgctcagatgccggcatatagatcaaattaaacgattggaatcaattttaaaaacaatggagaccattaaagtaacgaagttgagagaaccgaggcttcgcgaccgtctcgcagtccgccacggaagatacattcagcgtgatgccgatgacaaaaaaaccttccgttttgaaagggacgagctcggtcttctggttgactttatggccgagctgtttaaaaaagaagggcacaaactgatcggaatccggggaatgccgagggtcggaaagacggagtccatcgttgcgtcaagcgtttgtgccagcaaaagatggcttttcgtatcatcaacgctgctaaaacaaacgatccggagccagctggttgccgatgaatacagcacggaaaacgtgtttatcctcgacggcatcgtttcgacaagacggggatctgagcgccatcttcagctcgtcagtgaaattatgcggcttccggcgacaaaggtcgtggagcaccccgatatttttgttcaaaattcggagtatacgctcgatgatttcgattatattatcgaactcagaaatgatcctgacgaagtcattacatatgaacatgcagaagaaccgcaaatgtttgaccagaccggtttttcaagctttgatttttaatattggaaggtgtttgttgtgacagaattagcaatccggcttaaagaagccagagaggaaaaagggatgtcattggatgaactccaggcggcgacgaaaattcagaaaagatacttaaccgctctggaagaaggcaattatgacgtcattcccggcaatttttatgtgcgggcgtttatcaagcagtacgctgaagctgtcgggcttgattcagatcagttattcgaagaatataaaaaagacatccctaacacgtaccatgacgatgtgtcggaaaaaatctccggtctcgccatgcaaagggagcttcctaagtccgcttcaaaggcggcggaatggcttccgaccgtccttgtcgtcatcggtgtcattatcgtcatcgcgatcatttatgcgattattcagttcggaatgagcaaatccgggcagacagacggagataaggccgtcacccaaagtgagagcaagtatgagattcctaaggattctgcgctgaaaaacgacggcaatacaaacgacgaagcgcaatctgacagcaaaaaagacacaaaagcgtcagagcagaaaaagaaagaaaaaagcagtgaaaagacggagatcaaagcggccggaacggaaggctcggcttcttcatacaacgtctccggggcagataagtataagcttgaactgattgcttctgacagcgcatggatccgcgtccgtgatgacagcggcggttctttaaaagaaggaacgctgcaaaaaggcgaaacctttaaaaaagacgtcacggatcaaaagcagattgaaatccgcacgggctatgcccctaacctgaaaattaaaatcaacggagaggttctgtcctatgaactcaatccgcatgatatgatggcgcagaccatcacaatcaagatgaaaaaataaaaggggaaaaagtcatctgaacgattaagatgactttttcttcacgtccgagtacatattattggaggggctttatgtttaacttaccgaataaaatcacactggcaagaatcgctttaattcctgtatttatgattatcatgcttgttccttttcattggggcagcgttcatataggggatgaatcgattccggtcgcgcatcttacgggagctgttttgttcattatcgcatcaacgactgactgggtggatggctactacgccagaaaactgaacctcgtgacaaacttcgggaaatttttagatccgctggctgacaaactgctggtgtccgcggcattaattacgcttgtgcaatttgaccttgcgccggcgtggatggtcatcatcatcatcagccgcgaatttgccgtaacgggattaagacttgtgctggcgggaacgggggaagttgtagccgccaatatgctggggaaaattaaaacatgggcccagatcatcgctgttgccgcgcttttgctgcataatcttccgtttgagctcgtttctttcccgttcggcgatatcgctttatgggtggccgtgctcttcacagtcatttccggctgggattattttgcgaagaactgggatgcgttaaaaacatctaactaaggaagaaggacttaaagatggaaatagcaaaaaaagcagaaatcattgcggtcggctcggagcttctgctcggccagatcgccaatacgaacgcgcagtttatcagtaaagaactggcggaaatcggtgtaaacgtgttttaccataccgctgtcggtgacaatccggagcggcttaagcaagtcatccgcattgccgaagagcgctcagacctgattattttttcaggcggcctcggaccgaccaaggacgatttgacgaaagaaaccattgcaaacacactggggcgcccgctcgttctgaatgacgaagcgttccggtcgatcgaagaatatttcgcgaaaacaaaacggaccatgtcgccgaataaccgcaaacaggcgctcgtcattgagggctcggacgttttggcgaatcatttcggcatggcgccgggaatgcttgcagagcacggctcaaggctttatatgctgcttcccgggccgccgagcgagctgcgtccgatgtttgaaaatgaagcgaaaccgctgcttcttaaaaagcttggttctaatgagaaaatcgtttcaaccgtgctgcggtttttcggaatcggtgaatcccagcttgaagctgatttagaagatatcattgacgcgcagacgaatccgacgattgcgccgcttgctgctgacggcgaggtcacgctgcgtttaacggcgaaacatgctgacgaaaaagaaacagaacggcttttaaaagaaacggaagccgccattttagaacgtgtcggtgaatttttctacggatatgatgatacgtccctggtgaaggagctttcaaaagcatgcagacaaaacaaaatcacgatttcttctgccgaaagctttacaggcggcttgttttcagagtgggtgactgatttaagcggtgcgtctcaactatttgcaggaggtgttgtctgctattccgacagcgtgaaacagcatgtgctcggcgtgaaagctgagacgctcgcagaaagcggagcggtcagcaaagagtgtgcgaaagagcttgcatccggtgtgagaaagctgaccggaagcgatatcggcatcagctttaccggggtcgcgggtcccgacccgcaggaagggcatgcgccgggccgcgtctttatcggcatttcagcggaaggaaaagaagaggtgcacgaatttcactttgccggctcaagaaccggaatcagaaagcgcgccgctaaatacggctgccatctcattttaaaaatgctggatcaaaaataaagttttaaagagcttttttctctgatttttaagtttcataagggaaattatgctcttttgcagaaaagcgaacgcggaaaaaatccgaatatgcgttcgcttttttcttggcaaatgccagtaaacaaggtatagtatatgtagtggcaagataaaggaggaaaaaataaatgagtgatcgtcaggcagccttagatatggctcttaagcaaatagaaaaacaattcggcaaaggttccatcatgaagctcggagaaaaaacggatacaagaatttcaacggtgccaagcggctcccttgcacttgatactgctctcggaataggcggatacccgcgcggacggattattgaagtatacggacctgaaagttcaggtaaaacgactgtagcgcttcacgcaatcgctgaggttcaggaaaaaggcggacaggcagcatttattgatgctgagcatgctcttgatcctgtttacgcgcaaaagctcggtgtcaatatcgaagagcttctgctttctcagccggatacgggggagcaggcgcttgagattgctgaagcgctggtgcgaagcggagctgttgatatcgtagtcgttgactctgttgcggcgcttgttccaaaagctgaaattgaaggtgacatgggtgattcacacgtcggtttacaggcgcgtcttatgtctcaggcgctccgtaagctttccggcgccatcaataaatctaaaacaatcgcaatctttattaaccagattcgtgaaaaagtcggcgttatgttcggaaatccggagacgacaccgggcggccgcgcgctgaaattctattcttccgtgcgtcttgaagtgcgccgtgccgagcaattaaagcagggcaacgacgtgatggggaataaaacgagaattaaagtcgtaaaaaacaaagtcgctcctccgttccgtacggctgaagtggacattatgtacggtgaaggaatctccaaagaaggggaaatcatcgaccttggaactgaactggatatcgtgcaaaaaagcggttcgtggtattcttatgaagaagaacgcctcggtcagggccgtgaaaacgccaagcagttcttaaaagaaaataaagacatcatgctgatgattcaggaacaaatccgtgaatattacggtttagacaataacggtgtaacggacaaagcggaagaagttcaggaagagatggaattagaagaataaaaacacgatcaaaagagcggaataagcaatttccgctcttttttttgtatgtttcaaaaaaacactggctgtttcggaaaattttatctggaatgttacaacttttttcacccttcactcgtctaacatcatggcgaaagttgaaattatatctgaggaggaaaaaagatgacgagcccccgccgcacaagaataaataaaaaaagaaagaagaagctgatgaaaacgggagggctgtttctttttctgctgcttgtcactgtttttattatgatctggaccgtcacagcgcatcatcgggagaaggaatccgttaaaaacgctcccgccgctcaatctgatacttcaaaagaccagactcaacagaaaaaagaaaagacgcaaaaagagaaaacacctaaatcaatcgatcacaataaacagatcagcaattacttgcaacagatcgggttcagcggcacagcaatgatcgtaaaagatggaaaagttgtgctgaaaaaaggctttggctatgcagaccgaaaacaaaaaattaaaaacaatccggagacatcatattatatcggttcttcacaaaaagcgttaatcgcgacggctgtcctgcagcttgaagaaaaagggctgctgcagacgagtgaccccgtcagtacatacttgccgaattttcctaacggcacgcgcatcacattgaaaaacctgctcaatcatacgtccggcataaacgggcatattgagggtcggggaccgatttctccaattgatttaatcaaggatatagaataccgcggaattaaaaggcagcccggggtttgggattacagggattccaactattcagtgcttgcttatatcgcatctcaggtcagcggggagtcttatgaacaatatataaaagaacacgtgttcaaaccggccggaatgaagcatgccggattttacaaaacatttgctgaagccaaatatcctgccgtcggctacaaagtcgatgagagcggcagtcttgtaacgccgcaccttttggacttatcgcagctttacggggcgggcgacatgtatatgagcgctgaagatctttataaatttgataaagcgatcgtaaacggcacgctcctttcaaaagaaagcttcacaaaaatgtttacagcaggaagcagtgccgcttacgggatggggttttacattgatccgggcagctattccaatcacggtgttatgcccggttacaacattttaaacagtttcagccattcggcaagcaaatatgtcatattactgtcaaacattcagaataacgccaaattaggacaggtaaacaatagaatttaccaattgcttaaccaggcggactgacagagccgtcattcacgaaaagcggatgaaggtatggtatgatatatacatgggcggcgatccgagctgaaggcgaatcgttaagctggcaagcttgacaagtatttccgacacaattacaatgaagttgtaacatttgtttttttaacatgattgttaaaccatttaaacttgacaagggcatgagagactcattccctgtgaaggttctgtatgttgagaaaatcagacaatgtacatgccggcacttatttaagcaaaaaccaagttcatagcaagaggaggtgaaagtatgaccccaatgacggttctcatctccattttgctgactctgctcggtttagttgttggctactatgttcgtaaaaccattgccgaagcaaagattgcgggcgcacgcggtgctgccgagcaaatccttgaagatgcaaagcgtgatgctgaagcactgaaaaaagaagctctgcttgaagcaaaggacgaaatccatacacttcgaatagatgctgaacaggaagttcgtgaaagacgaaatgagcttcaaaaacaagaaaaccgtttacttcaaaaagaagaaaatcttgaccgtaaacatgaaggaattgataaacgggaagcgatgttggagaagaaagatcattctctgaatgaacgacaacaacatattgaagagatggaaagcaaagtggatgagatgattcgtatgcagcagtcagaactcgaacgcatttcgagcctgacacgggatgaagcgaaacaaatcattcttgaccgggttgaaaatgagctttcacatgacatcgccatcatgacaaaagaaaccgaaaaccgtgcgaaagaagaggcagataaaaaggcgaaaaacattctgtcgcttgctttgcagcgctgtgcagcagatcatgttgccgaaacgacggtatcggtcgtcaatcttccgaatgatgagatgaaaggacgtatcatcggccgtgaagggcgtaacattcgtacgcttgaaacgcttacaggtattgacctgattattgatgacacacctgaagcagtcattctttccggatttgatccgatcagacgggagacggcaagaatcgctcttgataaactcgttcaggatggccgtattcatccggcgcgcattgaagaaatggttgaaaaatcccgccgtgaggttgatgactatatccgggaaatgggtgagcagacgacgtttgaagtcggcgttcacggacttcacccggatctgatcaagatcctcggccggttgaaattccgtacaagctacgggcagaacgtactgaaacattctatggaagttgcgtttttagccggtttaatggcttccgagcttggagaagatgcaaagcttgccaagcgtgccggtcttctgcatgacatcggaaaagcaattgaccatgaagtggaaggaagccacgtggaaatcggagtggagcttgcgaccaaatataaagagcatccagtcgtcattaacagtattgcgtcacaccacggagacgaagagccgacttccattatcgccgttctggttgctgccgctgatgcactgtcagccgcaagaccgggcgcgagaagtgaaacgctcgaaaactatatccgcagacttgaaaagcttgaagaaatctccgagtcttacgaaggtgttgaaaaatcatttgcgattcaggccggccgtgaagttcgcatcatggtgaagccggactccattaatgatttagaagcccatcgtttggcgcgtgatatccgtaaacgaattgaggacgagcttgattatccgggacacattaaagtgaccgtgatcagagaaactcgagccgtagagtatgcaaaataaagtgatgcttagcgcatcactttatttttttgagtccctgaaaaggaaggaatggaatgtatgagaattttatttatcggagatgttgtcggttccccgggccgcgacatggtaaaagaatatgtcccgaaactgaaagcgaaacataaaccgcattttacaattattaacggagaaaatgcagcacacggaaaaggactgacggaaaagatctaccacagcctgatggaagcgggagccgacgccattacaatgggaaaccatacgtgggataaaagagagatcttcgactttattgatgatgtgccgcatcttgtccggccggcgaatttcccggaaggtacgccgggcaaaggcattacttatattaaatcgaacggaaaagagcttgccgtcattaatttacaggggcggacgtttcttccgccgcttgatgatccgtttgctaaagcggatgaattaatagaagaagcgaaaaagcgcacaccgtacatttttattgattttcacgcggaagcgacaagcgaaaaaattgcgatcggctggtatacagacggaagagcctctgccgtggtaggcacccatacacacgtgcaaacggcagataaccgcattttgccgaaaggaacggcatatattactgatgtaggcatgacgggtccgtacgacggaattctcggtatggacagagaaacggtcatcaagcggtttaaaaccaatcttcccgtccggtttacggtggcggaaggtaaaactacgctgagcggagtgctcattgacatcgacgatcaaacgaaaaaggccgtaaatatcgaacggatattaatcaatgatgaccatatgttctttgaataggtgatcatgtgtttattttataaaaatattaaaaggaaaagcaggaatatagcaacttcttagtgaatatagtagaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcaagtccaaattcagtagcaggcgcgcttgccggcgtattgagagaacgcggagccgccgaaattcaagcaattggggcgggtgccttaaaccaggctgttaaagcggttgcgattgccagaggctttgtcgcgccaagcggcgtagatttgatttgtattccggcttttacagatatacagattgacggagaagaaagaacggcgattaagttaatcgtcgaaccccgttaaaaacaaaaatatgtacattctcaacctgcttgcgtaaggcgagcaggttgtttttattgctgtcatattttctcacaatattatattgatagtacgaagagatgataaatggctttattcatataatattcaaaaaaaatcccgcccatttttccggacggaagcagttgttttcctcgagtggacactggtgtttacctcctttttatctcatgttacaatccagttattacagtgttttttcgaggaggagtgtacatgttgggaggaaagatgaaagctatcgttaaaaatgaaaacgctttcggagcaacgctgaaagaaattcccataccttccattaatgagaatgaagttctcattaaagtacaggccgcatctatatgcggtacagatgtgcatatttataattgggatcaatgggcgcagaaacgaatcaaaacacctcaagtattcggacatgaattcagcggtatcgtagcggaaacgggcaagcacgtcacaaatgtcaaaataggtgactacgtttcggctgaaacccacttcgtctgcggtacttgtgtcccgtgtttaacagaaaaacatcatgtgtgcacccatacaaagatcctcggcgtagatacagccggctccttcgctgaatatgtcaaagtgccggcccgaaatgtttggaaaaaccccgctgatatggaccccgccgtcgcctctgttcaagagccgcttggcaacgcggtgcatacggtgctggaaagcagccggcttgcgggcggttccgctgcaattatcggctgcggaccgatcgggctgatggcggtggcggtggctaaagcggccggtgcatcccgtattgcggccattgataaaaatgattacaggctggctcttgcgaagaaattgggagctgcgatcaccatttcagttgatgaggaagatccgcttgaggtgatcgacaccttaacaggcggtgaagggatcgaccttgtctgcgaaatgtcaggccacccggcagccataacacaaggattaaagatggcggccaacgggggaaggttccacatgctgagtctgccggaacgtccggtgacggttgacctgacaaatgacgtggtgtttaaaggacttaccgtccaaggcatcacaggcagaaaaatgtttgaaacatggcggcaggtatcgcacctgcttgaatccggccttgttgatctgacgccggtgatcacgcatcagtttccgcttgaagactttgaaaaagggtttgacctgatgagaaagggacagtgcggcaaagtcattttgattccataaggggagggttctataatgaaagaatttgaatttctaaaagcagagcttgataaaatgaaagaaaataaaacgtggcagcaaatgaaacaaattgaaacgaagcagggtccgtcggtggaagtcaaaggggaaaacgtgatacagctttcatcgaacaattatctcggtttgacgtcgcatccaagacttgtcgaagcggccaaacgcgccgcggaagaattcggagcgggtacggggtccgtccgtacaatcgccggaacattcacaatgcacaatgagctggagaaaaaattggcaacctttaaaaaaacagaagcggcacttgtttttcaatcggggttcacaacgaatcagggcgtcttatcaagcattcttacaaaagaagatatcgtgatctctgacgaactgaaccatgcttccattattgacgggatcaggctgacaaaagcagataaaaaggtgtaccgccatgttgatatggacgatttggaaagggtgctgaaaaaatcaatgaattaccgcatgcgcctgatcgtcaccgacggcgtattctcaatggacggcaacatcgctcctttgcctgacatcgtcaaacttgcagaggcgtacgatgcctttgtgatggtcgacgatgcgcatgcttccggcgtactcggaaaaaacggaagggggacggttaatcacttcgggcttgacggaagagtccacatacaggtgggcacattaagcaaagccatcggagtgcttggcggttacgccgcagggtcgcaggttctgatcgattacctgcgccataaagggcgtcctttcttattcagcacttctcatccgcctgcagtaacggccgcatgcatagaagccattgacgtcctgctggaagagcctgagcatatggaaaagctatgggagaacacggcgtatttcaaagacaaactggttcaaatggggctgaccctcacaaaaagcgaaacaccgatcgtgccgatattaataggggaggaagaaaaagcccaggcattatcagaccttttattgacccgcggcgtgtttgcacaaagcatcgtgtatccgacggtcgcccaaggaaaagcgagaatccgcaccattattacggcggagcatacaaaagaggagcttgaccgggccctggaagtaatccgttcagccgcaaaagagcttcagcttgtgtaagggggaaatgattccctcttttttatttcttattgattcttattctcaataaggtgtacaataataggctggcggttgtgccaaacgcttttaaccagtatacttgagggtggaagtttcggttgaaaggagacattcgaacatgaatgaaaagcaaaagcaggaaagcggacaagtgaatccggcggacaaaaaatccgaaaaggattacagcaagtattttgaagccgtatatattccgccttctttaaaagatgcgaaaaaacggggcaaagaatccgttcaatatcataacgattttaaaatctctgaagaatttaaaggccttggtgaaggcaggaaattttatatccgcacgtacggatgccaaatgaacgagcatgatacggaagtcatggcgggtatttttatggcgctcggttatgaagcgacaaattcggttgatgacgcgaacgttattttattaaacacttgcgccatccgggaaaacgctgaaaacaaagtgttcggagagctcggccatttaaaggcgctcaaaaaaaataacccggacttgattctcggcgtctgcggctgcatgtcacaggaagaatcagtcgtaaaccgcatccttaagaagcacccgtttgtcgatatgattttcggcacgcacaacattcaccgtctgccggaactgttatcagaggcatatttatcaaaagagatggtcattgaagtgtggtcgaaagaaggggatgtcattgagaaccttccgaaagtccgcaacggaaaaattaaaggctgggtcaacattatgtacggctgcgacaagttctgcacatactgcatcgtaccgtatacccgcggaaaagaacgaagccgccgtcctgaggaaattatccaggaagtcagaagacttgcaagcgaaggctataaagaaatcacgctgctcggtcaaaacgtgaatgcgtacggaaaagattttgaggatatgacgtacggtctcggtgatttaatggacgaactgcgtaaaattgatattccgagaatccgattcacgacgagtcatccgcgtgactttgatgatcatctgatcgaagtgctcgccaaaggcggcaaccttttagaccatatccatcttccggttcaatcaggaagctcagcgatgttaaaaatgatggcccgtaaatatgacagagaacgctatctggagcttgtcggaaaaattaaagcggcgatgccgaacgcttcactgacgaccgatattattgtcggttttccgaatgaaacggatgaacaatttgaagaaacgctttcgttatatcgcgaagtggaatttgacagcgcatatacgtttatttactctcctcgtgaaggcacgccggcagcgaagatgaaagacaatgttccgatgagggtcaagaaagaacgtcttcagcgccttaatgatttggtgaaagaaatttcagccaaaaaaatgaaggaatatgaaggcaggactgtcgaagtattagttgagggagaaagcaaaaataaccctgacattcttgccggctatacggaaaaaagcaagctcgtcaacttcaaagggccgaaagacgccatcggcaagattgtacgcgtcaaaatcgaacaggcgaaaacatggtcgcttgacggtgtgatggcaggagaagcaatcgaggtgaaataatgatgacgctttactcaaagaaagacattgtacagcaggctaggaaccttgcgaaaatgatttctgaaacagaagaagttgattttttcaaacgcgccgaggcgcagattaacgaaaatgaaaaagtctctgcgattattaatcagattaaaaccctgcaaaagcaagccgttaacctgaagcactacgaaaagcttgaagcgctgaaacaagtggaaagtaaaattgacgccctgcaggaagagcttgaagggattccgatcatccaggaattcagagattcccagattgaggtcaatgaccttcttcagcttgtcgcacatacgatctcaaatcaggtgacaaacgaaatcattacatctaccggaggcaacctgctgacgggagaaaccggttcaaaagtaaaacattcgaataacagctgttctatttaaacacggggccttcatcggcccgtgttttttttgccgtttaagaactaattgtaatatgtactaaattttcattgtctcaacgttttgtcctatttttactggaaagttttatcatacttaaaagtaaagtttctgggcagggctgcatacaatgaaacagaaactttgtatttttatatttttattataaaaatgcacatgagacaaatgcccagcataagataacacgaagaagaacaaggaggcctgccggaatgtctgaatacagggaaattattacgaaagcggtagttgcgaaaggaagaaaattcacccaatgcaccaacacgatctcgcctggagaaaaaccgtcaagtatactgggcggctggattatcaaccacaagtacgatgccgaaaagatcgggaagactgtagaaattgaagggtattatgatataaacgtctggtactcttacgccgataatacaaaaacggaagttgtaaccgagagagtaaagtatgtcgatgtgattaaactcagatacagagatacaaattacttagatgacgaacacgaagtcattgccaaagtgctgcagcagccgaattgtcttgaagtcaccatttctcctaacggaaataaaatcgtggttcaggcagagagggaatttttagcagaagtggtcggtgaaacgaaagtcgtcgtcgaagtcaatcctgactgggaagaagacgatgatgatgattgggaagacgatcttgacgaagaattagaggacattaaccctgaatttttagtcggagatcctgaagaataagttgaggctaggggagtttaacaccccgagtctcttttttatatataaagatatcactcttttgtttatgttataatgggattcggataagagaagatacatagtgagggattaaatgatggctagttacacgcctatgatacagcaatacttgaagataaaggcagagcaccaagatgcctttttattttttcggcttggtgacttttatgaaatgttttttgaagatgcaaaaaaagcgtcgcaagagcttgaaattacactgacaagcagagacggaggttcggctgataaaattccgatgtgcggcgtgccgtatcattccgcggcggcttatattgaacagctgattaaaaagggctataaagtggcgatctgtgagcagacggaagatccgaaggcggctaaaggcgttgtaaaaagagaagtcgtccagctgatcaccccgggaaccgtgatggatggaaaaggcatccatgagtcggaaaacaactttatcgcttccgtttccgaatttcgtaacggatacggtctcgctttatcagacttaacgaccggagaaaacctggccgtatttattgagcggattgaagatgtcatgtcagaaatttactcagtcggcgcaaaggaaattgtcgtatcaagcaagtttaacgaacatacggctgctcagctgaaagaacggtgcggcgcaacgatttctatcgaagacggggaaataacagaacgcattgaaatcgcaaagcacttgccgggcgaagagctgacagagacgtttatgcgtttatatacgtatttgcagaaaacgcaaaaacggagcctggatcatctgcagccggttcaagtatatgaattggaagaagcgatgaaaattgacctgtattcaaaacggaatcttgagctgacggaaacgatccgttcgaaaagcaaaaaagggtcattgctttggcttttagacgagacgaaaacagcgatgggcggccggcttctcaaacaatggattgaccgcccgctgatcagggcatcccaaatcgaagaacgccaggaaatggtcgagacgctgatcaatcatctgtttgagcgcgaagatctgcgcgagcgcctgaaggaagtatacgatttagaacgtctggcgggccgggtcgcattcggaaacgtcaacgcaagagatttaatccagctgaaagaatctttaaaacaagtgccgagcattaaagagcttgtaggatctcttaaccataaaaaagcaaaagaacgcgccggcttgattgatccgtgcggagatttgcttgacctgttagaagaagcccttcatgaaaacccgccgttatcgttaaaagaaggcaacttaattaaagacggctatcatcagaagctcgatgagtaccgtgacgccagcaaaaacggtaaagactggattgccagactggagcagcaggaacgcgcttatacgggcatccgttcattaaaggtcggtttcaataaagtgttcggctattatattgaagtcacaaaagcaaaccttcatctgcttgaggacgggcggtatgagcggaagcagaccctcacaaacgccgaacggtacattacgccggaattgaaggaaaaagaagcgcttattttagaagcggaaaacaacatctgcgagctggaatatgagctttttgccggtctgcgtgaaaaggtgaaacaatttattccgcgtctgcagcgtcttgccaaacaaatgagtgagctggatgcgctgcaatgctttgctacgatcagtgaaaacaggcattacacaaagcccgtcttttctgataatgaagtaaaagtcattgaagggagacaccccgtcgttgaaaaggtgatggacagtcaagaatacgtgccgaacaactgcctgatgggcgattcgcgggaaatgctccttattacgggtccgaatatgtcaggtaaaagcacgtacatgagacagatcgcacttctatcgatcatggcccaaatcggctgttttgtgcccgcaaaagaagcggttctgccgatttttgatcaaatcttcacgagaatcggggcggcggatgatttgatttccggacaaagcacctttatggtggaaatgctggaagcgaaaaacgcgattgtgaacgccacaaaagacagcctgatcctgtttgatgaaatcggccgcgggacatcaacgtacgacggaatggcgctggcacaggcgattattgaatatgttcatgatcatatcggcgctaaaacactattcagcacgcattatcatgagctgacggtgcttgaagataagcttcctcagctgaaaaacgttcatgtgcgcgcagaggaatataacggaacggtcgtgtttctccatcaaatcaaagaaggagccgcagataaaagttacggcattcatgtcgcccagcttgcggagctcccggacgatctgatcagccgcgcgcaggagattttgaaacagcttgagcagacgggagataaaccggagcttccggcggcacctgagaaaaagcccgccgtcaaagaagaaccggcacagctgtccttttttgctgacggtgaaaaagaacagaaggcaccggctgtttctaataaagaaaaacaagtgcttgaagcttttaagtcaatcaatattctcgatatgacgccgcttgaggcgatgaatgaaatgtacaagctgcaaaaaaaattaaaatagaaagaggtgacggacttggcaaaagtcatccagctgtcagatgaactttcgaataaaatagcggccggcgaggtggtcgaacggcctgcctcagtcgttaaagaattggtggaaaacgccatcgacgcaaacagcacagtcattgaaatcgacatagaggaagcggggctttcgtcgattcgggtgctcgataacggcgaagggatggaaaccgatgattgcaagcgggctttccgccgccacgcgaccagcaaaatcaaagatgaaaacgacctgttccgggtgagaacactcggtttccgcggagaagctttgccaagtatcgcgtctgtttctcatctggaaatcaaaacgagcatcggcgagggggcgggaacccatctcattcttcagggcgggaatatcatttctgaacagaaatcctccagcagaaaaggaacggagattatcgttaccaacctgtttttcaatacgcccgccagattgaaatatatgaaaaccgtgcatacggagctcggcaatattacggatgttgtcaaccggattgctcttgcgcatccggaagtatccatccgtctccgccatcaggggaaaaatctgttgcagacaaacggtaacggggacgtgcgccatgtgctggccgcaatttacgggacggcggttgcgaaaaaaatgataccgctccatgtcagctcgcttgattttgaagtcaagggctacatcgcgcttccagaaatcacgcgtgcatccagaaactatatgtcatctgtcattaacggcagatacattaagaatttcccgcttgtaaaagcggtgcatgagggctatcacacacttctgccgatcggccgccatccgattacgtttatcgaaattacgatggacccgattttggtcgatgtcaatgtccatccgtcgaagcttgaagtccgcctcagcaaagagacggagctgcatgagctgatccgtgacgggataaaggaagtgtttcaaaagcagcggcttattccgagcgcccagctcccgaaaaaaacagcgccggcaccggccaaaaacgaacagcaatttatgacattcgaggaaagcgcgcctgagcggaaacttcctgaaaaaacgccggagccgtcttactcaccgatgaagctgagttcggtcgtaaaagagccggagccggtcatagaagaagagtccctgccggatgaagcaggtcacggagtgccgccggagctcggcatgccggtaacggaagcgcctgtttccgatattccggagcctgaagaggaggctgactctgaagaaatacgggaagaaagagttccggtgatgtatccgatcggccaaatgcacgggacgtatattttagcccaaaacgaaaacggcttgtatatcattgaccagcatgcggcgcaagaacggattaaatacgaatatttccgggagaaagtcgggcaggtcgagcctgaagtgcaggatatgatcgtgccgctcacctttcattatgcggcaaatgaagcgctgatcattgaccagcatcagcatgagcttgaaagcgtcggagtatttttagaagcattcggcacgaacagctacatcgtccgctgccatccggcctggtttccaaaaggggaagaagctgaactgattgaagaaatcattcagcaggtgcttgacgccaaacagatcgatattaaaaaactcagggaggaagcggccattatgatgagctgcaaaggctcaatcaaagcgaaccgccatttgagaaacgacgaaatcaaagcgctcttggacgacctgcgccgaacgacagacccgttcacatgcccgcacggccggccgatcattatccaccacagtacgtatgaaatggagaagatgtttaagcgtgtgatgtaataacaacgtttatgtgagactaaactgttatttacccacaagcagccttactagtttgaatgacccagcctttcagagataacttttgagttctggcataattgttgcatggtataccgtaaatcatgaagataatttgtttaacatccagttatttgggaaggatccctgaagtacaagatgaatactctgtatgcgggtacctgcttttacaaagtcacagggaagagatggggaagaatttaaataaaattggaatttggcgggttatactatccgcaagtcagtcaagggggactagtgattagcccccttacatttagttcttcctgcggtattttctatttttgatcaaactgaaaaccactaagagaaccacaccgacagcaacaatataaaatgaaatttccgctgcggcggtgttaatattcttaaggacaaggataagccctattaaaattataggaatgatgtaagttagaattcttatagctttcgggctcggttcagcattacttttatcttccatagttacctccgatcttaaacactttagaaaataatcactttaaagcttaacacaggataaatttgttaaacaccaacaatagccccatttaaaggaaaagcataagagttttagtaacccacaaagttgctgcctggttaccagttacttttagagcatccgcatagcacgcatcttcaactgcaccagtaaaattgtcaatgatattaagaattatttcaaaaccgccgattccacccatagcagctttaactttagtaggtattgcgtcccgagctgctctcagtgcttttatagctcaggacaaatcaccttgaacagtaaactccgacccatatcacatagtctatttgtctaaatcttaatatttactttttacacagtaaaaagataactttatttagccctaacaaaaacatctgagctccttgtcaataatcaaatataaatcgtcttcaactgacgtcttttttcatgcgcgacgctttcgtgaattgttgcagctagactggtttttgaacggttttctcgcaaaaaaaaagagtgtaaattaagctgtacttttctcagttcaattatgttaatgtcaacataacgttgaattcggtgtaagaactaaggtattctgatatatttcgagagcccgtgtggtttagtttatctgaagaaaaggattgaaataataatcttaattgcgggtcatttctaaaaactgattatctcctccggccgcttctgtaattgcttctcaaaacaaaagttcaatttgttttctttttatccgaaactcatattcatccttcattttctgaataaaattccctaaagaattcatctgaattaatattctgatttccttatatatcagcatagcaatttgtaaaaaaggcccagactggtgcttttggcgggagcagaaagttttttaaactttaccggaaaatccatggaaaaacgtggtgccatctggtaaagtggttacagtcggctgggcggcggcagcagtctgcccggatcttttaaatgggaatggtgacaatggatcatacatatgaagtgcatcaaatcaaaacttatcaccagatgtggtccaactattgttatattatcgcagaccgctcaaaaaaatctgcgatagcggtggacccgtcctgggaaatcgataaaataaccgataaactgcatgaattggatgttgatttatcagctattttattaacacattcgcattatgaccatgtaaacttggcggagccgcttcagcaaatctatcattctgatatatacatgtcgtcggcggaaatcgatttctatcaattccggtgcagaaacttaatagcgcttgaagacggacaaacctttgcggccggagggtttatcatcagaagtatattgaccccgggacatacggccgggggaatgtgctatttgctatctgatcacctttttaccggtgataccgtgtttacagaagggtgcggtatatgtgaggacaggggcagctcagctgaagatatgtttcacagtatacagaggatcaaagcctctattccgccgcatgtgcgtgtgtatccggggcactccttcggggagaagccgggtcaaaaaatggagagtcttttgaaaaacaatatttactttcagattgaaaaaaaagaacatttcgtgaatttccgcaacagaaaaaatcaaaaagggctgtttcactttaagtagcgtataatttggttctatctaactagtttttcttttaggccacggaacttctgaattgaaatgatagtcattgctcgctttttggtgatgaatggctgagtaacggtagtttgcggataaaagcgccgggcaggctgaatgggacattctgcttatgtctattccaaaagccctgagtccgccttccgtcagggaaaaataggcattattcaggattccgcataggataaattaacttgacatggtatttttgtgaagttactatcaacttgaacatgcttcttaactgaatccgagaaaggatggctgagaaaatgatcacatacatattccccggacaaggttctcaaaagcagggaatgggaagctcattgtttgatgaatttaaagacttaacggagcaggctgatgaaacactcggatattccatgaaacggctttgtcttgagaatccgtattccaatcttcacaagacgcagttcacccagcctgctttatatgttgtaaacgcgttaagctatttgaaaaaaatccaagaaaatgacataaagccggattatttggccggccacagtttgggagaatataatgcgctgtttgcagcaggtgcttttgattttattaccggcctgcagcttgtccgtaaaagaggcgaattaatgagtatggccactgacggaaaaatggccgccgttatggggttaaccgcagctcaagtgtcggacgcccttcaaacgcacggattacatacgattgatattgccaatatgaattctcctcaccaagttgtcatatccggacgcaaagaagacattgaaagagccaaaagcgtattcgaaggaataaaggacgttacgatgtttcatccgttaaacgtcagcggcgcttttcactcgagatatatgagcgaagcaaaacaagagttcgaaaaatttttacagtcatttcatttttctgctatatcaattcctgtcatttctaatgtgcatgccaggccttatgagcaagacggaatccactccgttctggccgatcagatcgaccattcagtgcgatggaacgacagcatgcgctatctgctggacaaagggcggatggaatttgaagaagtcggcccgggccatgtgctgacaggacttattcaccgcatcaaaaaagaaactgaagcttcacccgccatgtagcggaacgcaagtcaaaattcttatctcacataatagtgccagccatacaacatcacgaccacttcacctgcacacaacatcaagaaaaacttacaaatcaatattttaaaaaaataaagagcaaaaaggagaacaaatgaaccagccaattgttttcatgttttctggacagggttcccaatactatcaaatggggaaagagctgtttgcacataacgccgcttttcggcagaaaatgcttgacttggacgattttgcagtcagccgtttcggttactctgtcctgaaagaggtttatcatacaggcaatcgtctgtctgatccatttgaccgccttcttttcagccatcctgccatttttatggctgagtacgcacttgcatatgctttggagcaaagaggcatacgtcccgattatgtgatcggagcaagccttggagagtatgcagcggccgctgtgtcgggtgtgctgagcgctgaggatgctttagattgcgtgctggaacaggcccgaatcattacggaaacttgccgtaacggcagcatgcttgcgatactgggtgatccggctttatatcaagatgatccgctgctcggcgaacatagtgaattggcatctgtaaactatcattctcactttgtcatctcgggagagcgggaacatatcaaaaagatcatggacgatctgagagaaaagcagattcctcatcagctattgccggtatcttacgggtttcactcagcgctggttgatcaggcggaacagccgtacaagcgctttttagctcagaaattaatccggactccgtttataccgtacatctccagtgcgaccggagaggctgagaccgatatacaagcggactttttctgggatattgtaagaaagccgattcaattccgcgaagcgcttcaattcgcagacagccgccaaaaaggattgtatatcgatgccgggccttccggaacgttggccgcatttgccaaacagattcttcccgcaggatcggctgaacgcatccgtgccattatgacgccgtttcataaagaacaaacccatttgcagcaaatagaagacagcattttatcaccgcccggaaggagactgtaagatgatcagctttgtttttccaggccaaggctcgcaaaaaatagggatgggagaggacctgttcggccgctatcctgaattaaccgcaaaggcggatcacattctcggatattccattcaggagctgtgccgggacggagaacgtctcaatcagactcaattcactcagccggcgctctatgtcgtcaatgccctcagttatttgaaaaaaacagaagaaaccggcttgaaaccggattttaccgccggacacagtttaggcgaatataacgcgttatacgcctcgggcgcttttgattttgaagaaggcctacagctggtcaaaaaaaggggcgacctgatgagccgcgcaaaaggaggcggcatggcagcggtgatcggcctgactcatgagcaggtgacggacgttttaagggagtatcacttgcatacgattgatatcgccaacatgaacactccgcagcaaattgtcatttccggatataaagaagatattgaaaaagccgcatccgtttttgaagccgtaaacggcgtaaaaatggttcaccgcttaaatgtcagcggcgcctttcattccagatacatgctggaagcgaaggaggaattttcacggtttattgaaactttccattttaagccgctgtccattccggtcatttcaaatgtgacggcaagaccttatgagcagaccgagctgaaaaagacactcaccggacaaataacgggatcggtgaactggacagacagcatccgttttttaatgggaagaaagaacatgatctttgaggaaatcggtcccggaaaagtgctgacggggctgattcaaagaattacggctgaagcggagccgataacagatgaaatcaaagtcccggctgaagctggaaaaagctcaattacggcggagtctttaggaaatgaagagtttaagcgcgattatcaattgaaatacgcctacttggccggcggcatgtaccgcggaatttcttcgaaggaaatggtcgtcaaactggccgaaaaaggaatgatgggctttttcggaacgggcggtttgaacatcgcgcacgttgaggacgccattttgtcaattcagcatgagcttcgtgacggcggttcctttggcataaatgttgtacataacatgaagcatacagattcagaagaaaaaatgattgatcttttactgaagcatggggttcagaacttggaagcatcagcatttttaacggttactcctgctttagtaaggtttcgcgctaaggggttaaaacgcggtgccggcggacaaataatagcgcgtcagcggattatcgcaaagctgtcccgtccggaagtagcggaagcatttctcagcccggcgcctgatcacattctgcagaaacttgcagccgaaaacaaaattaccgctgaagaagcaagtctgatgagagaaatacccgttgcgcatgacatctgcgtagaggctgattcaggcggccacactgacggcggagttgcttacagtctcatgccggcgatcatccgtttacgagatgacatgatgaaaaaataccgatacggcaaaaccgtccgcatcggagccgcagggggaatcggaacgcctgaggctgctatggccgcatttatgctcggcgctgattttattgtgaccggatccattaaccaatgcaccgttgaagcagcgacgagcggcctcgtaaaggatctcctgcagcagatgaatgtacaggacacggcctacgcgccggccggcgatatgtttgaatcaggcagcaaggtgcaggtattaaagaaagggctgttctttccgacccgggcctctaagctgcatgaactgtatcagcgtcaccgctcaattgaagaaattgatgaaaagacactcagacaaatagaagagaagtattttaaggcaagtgtaagcagtatttatgacaaagtgaaggctcattattcgaatgaagacatttcaaaagccgaacggaatccgaaacagaaaatggcgctcatattcaaatggtatttcaggcaaagctctgcttcggcgattaaaggagacccggatgccaaggtagacttccagattcattgcggcccggcattaggcgcctttaatcaatgggtgaaaggtacggagctggagtcctggaaaaaccgccatgccgatggtatcggccttcgtcttatggaagagacggcctcgcttttgaatcagaagttaggctcatttctgcaaacgtgttgacaagacgaaatgatagattgaaaacatggaatattcataaaagatgaaacagggaggaactgacaatgagtgaagaaagaatctttgaattgctgcagaacacaatctacgaggttttgcctgatttagaaggcgaacagctttcaaaggaagaccggttagttgatctgggggcggactcagtggaccgcgccgaaattatcacgatgatgcttgaagaattatcactgcagatcccgcgtgttgagctgacgggagtgtcaaacatcggcgaattggcggcaaagctttatgaaaaggtacaggctgtctgataaaacggtgaaaaaatcggaaactcaaaattcatattggaggcgaagttcatggcggctgccggaatagaagcgataaatgtgtttggcgggacggcataccttgatgtcatgcagctggcggagtacagaaacttagaccctgccagatttgagaatttactgatgaaagaaaaagcggtggcgcttccgtacgaagaccccgtcacattcggcgttaatgcggcaaagccgattatcgaccgattgacagaggctgaaaaagacagaatcgagctgctgattacctgctcggagtccggcatcgacttcggaaaatcactcagtacatatattcatgattatttaggcctcaaccggaactgccgtttatttgaactgaagcaggcctgttattcaggaacggcgggtttgcagatggcgcttaattttattttgtcgcagacatcccccggagcgaaggcgcttgtcgtcgcgacggatatttcccggtttttaattgccgaaggcggcgatgcgttaagcgaggattggtcttacgccgaaccgagcgccggagcgggtgccgtcgccttattgatcggtgaaaacccaatcgtatttcaggcggatgcgggcgccaacggctattacggctatgaggtgatggatacatgccgtccgatcccggacagtgaagccggtgacgccgacttgtcattgatgtcttatctcgattgctgcgaacagacatttcgcgagtacaaaaaccgtgtgccgggcgctgactataaagagacgtttcactatcttgccttccatacaccgtttggcggcatggtcaaaggagctcaccggacgatgatgcgtaagcttgcaaaagcgaaaaacgctgagatcgaacaggattttcaaaccagggtagagccggggctccgctactgccaaagagtcggaaacattatgggggcagcctctttactggctcttgcaagcacgattgatcaaggggctttcgacacttctaagcggatcggctgtttctcgtacggctccggatgctgttcagaattttacagcggcgttgtgacgcctgaaggacaaacgcggcagcattctttcaaaatagaagagcatctgaacaacagatacaggctgtccatggaagagtatgaagaactgtttaaaggcagcggtctggtgaagttcggaacccggaatgtcaaattggatatgaatatgattccgaacattttagaccatcatgccgggagccctcgtttatatttggaagaaatcacggaatttcatcggaaatacaggtggatcccgtgacctatgagacgatcaacgtccgttttcagcaaaatgtctgcttcatcacctttgatcggcctgaagccaacaatacgattaatgagcgtttagtggaggaatgcctgcacgttcttactgaatgtgaagactccgtgacctccgtagtgcttgaagggcagccggaggtattttgtttcggggcggattttgatgagatgtaccggaaaatgaggcagggaatgcagcatgcggaatcgcaggagccgctttaccgtttgtggctggcattaaaatccgggccgtacatcacaatcgcccgcgtccgcggaaaagtaaatgcgggaggtgtcggttttgccgccgcctgcgatatcgtcattgcagaggagagtgcttcgttcagtttatctgaactgttattcggactttatccagcctgcgttctgccgtttttaattcaaagaatcggatttcaaaaggctcattatatgacgatcatgacaaagcccgtgccggcacgccaggcgcttgaatggggactttgtgacgtatgcgtcccggactcagcaacagagctgagaaagcatttgctgcgtcttcgcccgctgtcgaaaaaagcagtcatccgctataaaaaatacatggattccttaaacgaccttgttcatcgttcgaaatccattgctctagccgaaaatcaagcgatgttttcagatccggataaccaatcagccattttccgttatgcagaaacggggcggcttccttgggaaacggagaacagttaggaggatatcatgccgaacgccgcagttgaactgctcgaaattgaaccggatattatccaagtgacaatgcaggataaagcccataaaaacgctttctccaaagaactgacggatggattgatggaagcattcacccgtataaaaaaatcgtcagtctataaagctgtgattttaacaggatacggccattactttgcttccggaggcacacaggaaggtctgctcaggattcagcagggcatcacgaagtttacggaagaccgcatgtattctttggcgctggaatgtgatatccccgttatttcagccatgcagggccacggaatcggaggcgggtttgtcatggggcttttcagtgattttgtcattttaagcaaagaaagcgtgtataccgcaaactttatgaaatacggtttcactcccggaatgggggctacctttatcgttccggagaagcttggggcaagcctcggccatgaaatgctgttaaacggcggccactaccgcggcggtgacctggagaaaagaggagtgccttttccggtgcttccgcggcaggaagtattagactatgcgcaggaattggcccgtgagcttgcggaaaaaccgagaaactctttaattacattgaaaaggcacttggtgacgccgtttcgcgagcagcttccggctgtcattgagaaggagttaatcatgcacgatgagacgtttcatgatgatgaagtgaaaaaacgaatcacgacgatgtacggagtataagacatacatcttacatacagatgaaatggaggcagctctatgaaaagtgatatgaaggcaagcgggttactcaagccatctgtcagctacggaaaaccattgcggctttcagcggatcagccgatgacgattcctgaagtcctgcacaaaaccgccgcggcagcgggagatcaaaagggcatcacatatatacagcctgacggcaccaaagtgtaccagacttacagcggcctgaaaaagatcgctctttcgattgtgaaagggctccgccaatcaggagtgaaggctcaggatgaagtcatattacagctcagtgacaattcccagctgattcctgcgttttggggctgtgtttttttaggagcgatcccggttccgcttgcggccgctccggcttatacagaaatgaacagcgggacgcaaaaactgaaagacgcctggacgcttttgaatcagccgtatgtcatcacaagccgtgaagtgctgccggagatgactgaatgggcggaggagcaggagctttccgggttttgcgctttggcggcagaagatctcagtgcgcatgaaatggatacggactgtcatcatccccgtccggaagatttggcgatgctgcttttgacctcgggaagcacgggcacgccgaaagccgtgatgctcagccatgaaaacatcgtctgcatggtcaaaggaaatattcagatgcagggctatacaagtgaggatgtcacgtttaactggatgccttttgaccatgtcggcggcatcggaatgcttcatctgcgtgatgtttatctcggatgtgaggaaatcaacataccgagcgaatccattttgatggatcctttaaaatggctcgacctgattgatcattaccgcgcttcggtcacgtgggcccccaattttgcctttgggctgcttgccgatttcgcagaagagattcaaacacggaaatgggacttatcttccatgcgttatatgctgaacggcggggaggccgcggtggcgaaagtcggacgcagaattatggagcttttagagccgcacggtctgccggctaatgccatccgtcccgcatggggaatgtccgaaacgtcttcgggcgtaattttctcagatgagtttacactggaaaacacgagtgacgacgatcgtttcgtcgagatcggtctgccgatcccggggtttaatatgagaattacggatgaccgcaatcaagtggtggaagaaggagaaatcggccgctttcaagtgtccggtctgactgtaacgagcggatattatgagcgcccggacttaaacgagagtgtctttacagaagacggctggtttgaaacgggagatctcggatttctgcgtgaaggccgcctgacgataacggggcgcacgaaagatgccatcattatcaacggtgtgaattattacagccacgccattgaatcagccgttgaggaattgccggaaattgaaacgtcatatacagcggcatgcgccgtccggccgaatcaaagcacgacagatgagctggcgattttctttgtgacgtctgttccattggatgagaaccgcatgacgaagcttattcatcacattcaccagcacgtgacacagagaatcggcgttacccctgattatctgcttccggtcgcaaaagaagacattcctaagacggcaatcgggaaaatccagcgcactcagctgaaacattcattcgaacaagggcaatttgattcattacataataacagacaagaaggcggcaattcagccccggcttctgcagagaaagaaattgaacgggattttatccgttttctgaaagaggaactttccatcgcggatgagcttgttgatccaaatacaccgtttcaaagccttggcgttaactccatcaagatgatgaaactcgccagatcaattgaaaaaacgtatcacatccggctgacggcaagagagctgcacaaaaacccgacgattggcgctttagcggcttatactgctgaaaaagcggcaaacatgtcagcggagcatcattcccaaaaagccgaaccgccggcagaacgggagagacggcaaacggcgccagcgctttcagaagtccaaaaagggctgtggacattgcagaaaatgtcgcctgaaacgactgcataccatgtcccgctctgtttccgattcacaaccggaatcgacaaagagaaactgaaacaggcgtttcagctcgtattaaagcagcatccgatgctcaaaagcgccgtgaatgaaacagacggcgggttttatttcatagaagcggcagatccttttgtattctcggaagaagatatttctgacgtcaatgaatcacaaatacccgctctgatacggaaaaaagttaaagagccgtttgtcaaagaaggcgggcctttgctgcgcgtgcggctgctttcaaaatccgcctcggaacattatcttttgacggtcattcaccacatcgtgtttgacggtttttcatccattacatttattcacagtctgctggatcattatcaggcgctgctggagggaaaagaagagtttgcggccgccgctcccggcattcattccgatttcgcggcttgggaaaagcggtatttagcgggtgaagaaagcaaagctgcccgcgcttactggatgaaacagctcgggggcgatctgcctgaccttcagcttccgccgatgcgcacgggcagcagcgttccggagtttacagaagatacgctgacacgccgtcttcccgaacggctgctgaataatctaacggcgtttgccgcatcccgttcgattcatttgtctaccgttatgctgagctgctatatggtgcttttaagcaaatatacagataaggaagatattgtgacaggcatgcctgcgatggtcagacctgaagaacgctttgacggagtggtcggccatttcctcaacatgcttcctatacggagcagagccggacgaaaagaaacatttgctgactttgttcaaaaggtgcaggatgccgttctggacggactggatcactccttttatccgtttccgaaaatggtgcgtgatgtgcatgcgaaacccctgcagaacggttcgcctgttttcagcaatgcctttttctatcagaactttctgcagtattcaagctatcaatcgatgctggatgaatacaaggaattctcctgtgagtttgtaaaagacattcatcaggagggggaatatgatcttgtatttgaaatgtgggaagaagcatcaggcatggatcttacgattaaatacagcaccgaattattcgacgaagcaggggcggccagacttttcagccaatttgtacaggccgctgaagctttgacggcgaatccggatatgccgcttgagaacgtttctctcatgacaaaaagagaggagcacatgattcttaagacttggaatgagacaagccgtgaatatccggatgcctgcttccatgaattattcgaacgtcaggcggcagaaacgccggacgcttgtgcggtcgtgtatgaacagcaaaagctgacgtaccgtgagcttgatgaaaaaagcacgaagctggcgctctatttgcaggcgcacggtgcaggccctgatgatctcatcggcatttatacagaccgttcattgcatatggctgtcggccttctcggcattttaaaagccgggggagcgtatgtgccgcttgatccttcttatcccgctgacagattggaatatatgatcgccgacagcaggatttcaatgtgtctgacgacagctgatttagagcactccttgaactggggaggcgtgcagacaactgccattgaccgcgattggtctcgtattgaaagtacagccgcggaaagaacgtcgctgaagcggttagtgacacctgacgatctggcgtacgtcatttacacgtcgggcagcacgggcaaaccgaagggcgtgatgattccgcaccgggcgctgaccaatttcttaatctcgatggcgaatgaaccggggcttacgtccgaagacaaactgcttgccgtcacgacatattgctttgatatcgcggcactggagctttacctccctttaatcaaaggagcagagtgcaacatctgtaagacagaattcacaaaagacgcacggaagctgaaagagctgattcaagagtacaaaccgacgatcatgcaggcgacgccgtttacgtggaaaatgctctttcattccggatggtcaaatgaagaaaaagtgaaaatcctttgcggcggagaggcgcttagcgaacaattgaagcagcagtttctcgatacgaaaagtgaggcttggaatatgttcgggccgacagagacgacaatctggtccgcggtgcagcgtataacggaaaatgagagcgcgcttacgatcgggcgcccgatcgccaatacccgtgtgtatattatggattccgctctcaaccctgttttagaagggatgccgggagaactttgtattgcgggagacggattggcaagagggtatttcaacaagcctgagctgacagataacgttttcgtcagccaccggctcgaattgggatcaaagctttataaaacaggcgatatggcgcgttttcttcccggcggccgcattgaatacatgggacggatggacacccaagtcaaaatccgcggctaccggattgaacccggagatattgagagccggctgaatgcctatccggccgtacaggaaagcgtagtggttgtgaacaatcactccggaaatgaaaaactttgcgcattttatatcctgaaaaacggagagccgcttccgtctgcaaaggaattgcgcaatcatttgaaacaagcgctgccggcctatatgacgccagcttcgtttatccgtcttgaagagctgccgctcacaccgaacggaaaagttgaccgcaagcttcttgctgcccgcgatctgacggaaaagcagccggacacacaaacattttcatcatctcatatccagcaggcggtgctggcgatttggcaggatgtattgaaaagcaaagatatagagcttgatgaccgcttttttgatgcggggggagattcgcttcttgccgtgactgtcactgaccggatgacgcaggaactggattgtgaattcagtgtaacggagctgtttgaatacgcgacggtaaaagacatcagccggtacatcacagaacaaaaactgaaagaaaccgttttggctcctgtgccgcaaaagaaagtgaatacagaagaccgggaacacccagcgggagaaattcccgattattatgaggacagtgtcgcggttatcggtatatcctgtgagtttccgggagcaaaagatcattatgaattttggaataacatcaaagaaggcaaagaaagcatcaacttcttttcaaaagaggagctccgccgatccggtgtttctgaagaactggctgatcatcccggcttcgttccggctaaatcagttttagaggggaaagaaatgtttgatcccggtttcttcggcttttcaccgaaagatgcggaatatatggaccctcagctgagaatgcttttgctccattcatggaaggcaatcgaggatgcgggatatatctcaaaagaaattccggaaacaagcgtgtatatgtctgcaagcacgaactcttaccgcagcctgctgccggaggagacgacagcacagctggaaacgccggatggctacgtatcatgggtgcttgcccaaagcggcacgattccgacgatgatttctcataaactcgggttgaaagggccgagctattttgtccatgccaactgctcatcttcgttaatcggcctgcattcggcttttcaaagcctgcattccggcgaagccaagtatgcccttgtcggcggtgcgacccttcatacggaatcaagtgccggatatgttcatcagccggggctgaatttttcaagcgacgggcatattaaagcgtttgacgcggctgctgatggaatgatcggcggtgaaggagccggcgccgtgctcttgaaaaaagcgtcggatgccgttaaggacggcgaccatatttatgcgctgctgcgcggaatcggcgtcaataacgacggagcggataaggtcggattttatgcgccgagcgtcaaaggacaggctgaggtcattcagaaggtcattgatcagaccggcatccatcctgaaacgatcgcgtacgtcgaagctcacggcacaggaacaaaactcggcgacccgatcgaactgtccgcacttcaatcggtgtacggccgatatacagataaaaaacaatactgcggcatcggttcagtcaaaacaaatctcgggcatttggatacagcggccggaatggcgggctgcatcaaggttgtcatgagcttatatcatcaggaaatcgcgccgagcatcaattacaaagagccgaacccgaatcttcatttagaagactctccgttttacgtagcgggagaaaagaaagagttaacccgtgagaacagagcgcaccgcatggctttaagctctttcggtcttggcggaacaaacacacacgcgatttttgaacaatatccggatgcatccgaagcagcagacgctgccggtccgttcatcattccgttgtctgccagaaaaaaagatcgtctgaaggagtacgcaaaacagctgctggcttttctggaaagaaaaacggacgccggcctcgctgatcttgcctacacgttccaagtcggaagggaagcgatggaagagcgcgcggcctttatcacaagcggcactgcggagctcaagcggcagcttgccgattttatcaatgataagccggctgtaacaggctgctttagaggagaaaaacagcaggcaaaagatattgcctggctttctgatgatgatgacagcgctgaactcattgagaaatggcttgcgaaaggaaaaggaacgaagctctgtgaaatgtggagtaaaggtgtcgccattaattggcacaagctttacaaagacaagcatccgaaacggatcagcgtgccggtctacccgtttgcaaaggagccgtactggccgaaaaaagcagaaaagaaaacatctgccgcacacaccggagtctcagttttacacccgcttgtgcagcaaaatacgtcagatttggccgttcagcggttcagctcacggtttacaggctcagaatttttcctgaaggatcatgtggtcagggaaaaagcggtgctgccgggagcggcatatttggaaatgtcttatgaagcggtaaaacgggcgcttggcggcttattaaaagaccaagacagaataacgctccatcataccgtctggatgaaaccgatcgtcgttcacgaacaagagcgccaagtccatatcgcgctgtttcctgaagaggacggcatcatctcatatgacatttacagcgtaaacgctgacgatgaagaagtgctgcacagccaaggacgggctgaaatcataaaggctgaacgagagcctgaggccgacctttctgccatacaaaacagatgcacagcggacattcttgatccggcggccttttatcgggaaggccggagcagggggatgttccacggaaaagccttccaaggcattaagtccgcctttatcggcgagaaagaagtgctttcggatatacagcttccggattctgtttctcatacgaacggacaatttacgcttcatccgagcatcattgattcggctattcagacggcgacgatctgcattatgcaggagttttccggacaaaagctgattctgccgtttgcgctggaataccttgaagtcatcaaaccatgcacaccgactatgcgggcgcatgcacgcttcagcgaaggatatcaaaccggtgattccgtgcagaaagccgacattgacctgttcgacgaaacaggagcgctttgcgtgaaggtgagaggattctctacgagagtgcttgaaggcgatgcagaatcggctcagcggccatcaggctcggaaaaggtcttgtttgcaccggtttggaaagaagccgccgcatccgagaaagcttctgtccatgctgatgagcatttgatcatactttgtgaagatgcctgccgtataaaagatgaagcggcatccggcctgaaagacgccgagctgctgattgcagaaggtgagggagaaacagccgctgaacgcttccaaggctacgcgcagacaatcgccgaacacatccggcggatcatcagcgaaaaaaggcagggccgcattctgattcagactgttatttcagcagacggcagccagcaattgtttgcggggttaacaggtttgttaaaaacagccgagctggaatacggaaaacttgactgtcagctcatcgagatggaatcaatcggcgaaatgccggctgccgctcaaaaactgaaaaacgacagccatcggccgcatgataaacatatccgttatacaggagaaaaacggtatgtgaaggcttgggaagaaatgcatcctgcaggtggcggcgccgtctggaaggacgaaggcgtatatctgattaccggaggcgcaggaagcctggggttgatgttcgcaaaagaaatcgctggtcgcgtaaaacacccgaaaatcattctgaccggccgctcaaatctggcagaagccaaacagcgtgagcttgctatgcttcaggactcaggcgcaaatgtcgtctacaaaaagctgaatgcggcagaccggcgggaaaatgaagcgctgataaaagagattacggcggaattcggggagcttaacggaattattcacgcagcgggcgtgatacaagaccgtttcctgctgcaaaaaacgaaggaagagttctgggaagtgcttgatccgaaagtgatcggcaccgcttatttagatgaagccagcaaagactgcaaccttgactttttcgtattgttctccagtgtttccggcgttctcggcaatgtcgggcaggctgattatgccgccggcaacgcgtttatggatgcatacgccgcttacaggcaatcccttacggagaatggcctgcggcacggaaaaacgatcgcctttaactggacgctgtggaaagatggcggtatgcaggcgggagacgagacggaaagaatgatgaaaaaagctttcggcatggttccgcttcaaaaggcgtcaggcctggctgcattttatgaaggaatggctcaggaaaagccgcagcttttagcagctgaaggacacgcagcaaaattaaaacagtcgttcctgtccgtttctgaaactgaaaagccgcaggtggagaaaatagaacctgtatccgccgtttcgggagacaaatggcacggtgcgcttatcagattggtcagttcaattttaaaagtcggccaagacgagattgatattgatacggaactgagtgaatacggttttgattccgtatcctttaccgtctttacgaatcaattaaatgaagcgtatcagctggagctggcaccgacgatcttcttcgagcacgggacgatccgcagtttagcagagtatttgtcggatgaaacagagagaggtcttccttttcagccggaagaaaaacacgatgcagaagaatctcttcaagcgcttcacaccgctttgacagccatggtaagcagcattttaaaagttgaccgtgaggacattgatacagatacggaactgagtgaatacggttttgattccgtatcctttaccgtctttacgaatcaattaaatgaagcgtatcagctggagctggcgccgacgattttctttgagtacggaacgatcagtaatctcgccggatatttggcaaaagagcatccgggccgtttcggcgaaaagaagaaggagtctccgaaaaaagagcagccaaaagcccaaaaaccgaaaacgcatcggaaaaagcgtttcgcaacggtgatgaacgctagggcagcgacacaagagccgcgccgcttgaacccggttgccattgtcggaatcagcggccgattcccgggcgcgaaggatatagaggaattttggcgcaatctgaaagaaggaaaagattctatcacaaccattccgaaagaacgctgggattggcaagcgtttgatggcgacccgaatcttgaaaggaacaaaacgaatattaagtggggcggctttatcgacggaatagctgaatttgatccgctgttctttgggatttcaccgcgggaagcccaatatttagatccgcagcagcggctgttattgacttatgcatggcgggcgatagaagatgcgggctgtaagccggaaagcctttccggcacaaatacgggtgtctttatcggcaccggaaataccggttataaagatttgttcacaagggcaggtcttgcgccggaaggacatgcggcgacaggcagcatgattccttccatcggtccgaaccgtttaagctatttgttaaatcttcacgggccgagcgagccggttgaaacggcatgttcaagctcgcttgttgcgattcaccgggcggtatccgctatagaaaacggagaatgcgacatggcgatcgccgggggaatcaacacgattctgacggaagaagcgcatatcagctacagcaaagcaggcatgctcagcaaagacggaaaatgcaaaaccttctccaaagatgccaacgggtatgtcaggggagaaggcgcgggaattctgatgctgaagaaactgacagatgcagaacgtgacggcaatccgatttacggcgtgatccgcggtacggctgaaaaccacggcggccgggcgaatacgttaacctcgccgaatccgaaactgcaggctgatttattggtgaaagcatatcggaaagcgggagtggacccgagcaccgtcacgtatattgaagcgcacggtacaggaacggaattgggcgacccgattgaaataaacggtttgaaagcggcgtttcacgagctggcgaaaacaaatcaagagcctgaagtctccgatcaccgctgcggcatcggttcggtcaagagcaatatcggccatttagagcttgccgcgggagtatcaggcgtcatgaaagtgcttttgcaaatgaagcacaaaacgctggtgaaaagcctgcattgcgagacgatcaatccgtacattcagctcgatgacagtcctttctacatcgtgcgggaaaatcaggaatggacggcagcgaaagatagaaacggaaatgccattccgcgccgggccggggtcagctcatttggcatcggcggggtcaacgcccatatcgtcattgaagagtatgtcccgaaagcagccgctctgcctgagcacagcccggaaaatccggcaatcatccttttgtccgccaaatcaaaagaaaaactgttcgaacaggcgcagcagctgcaaaaagcgatccgtcaaacgccgtatacagatcaagacttggcgggcgtcgcttatacgctgcaaaccggaagggacgaaatggaagagcgcctggccattcttgcagcgacgatggcggaattggaaacaaagctggaagcatttacgaaaaatgagaaaaacatcgccgggctgtataccggccagtctcaccgcaataaagatacgtttgccttgttcacggcagatgaagatatggacatcgtcattgacgcctggattaaaaaaggaaaattcgccaagctggcagaggtatgggtgaaaggcggcgtgttgaattggaaccggctgtatgaaaagggtacgccgcgtttactcagtcttccgtcttatccgttcgcaaaagacacgtattgggtgcctgagaatcctgacaaaaataaggtccatacagaggaacggatgaaacgtattctgacaaaacaatgggaaccgagcccgctcgaactgcgtgaaccgtgcccacgttccgttgcgattttgacaggcggggacacgatcaatctcgcagaagagatcgcagcgcatatgccgaatcaccgtattatcacaacatcagaccttacaggtgaatatgactggcaggcgtttggcggagtcatcgaccttctcggtgcagcgaaagaagaagcttctggagatatgaccggtatcaaatggcttcagcaattgattgagcatgggcataaagaagggataacactgctttgtgtcacgaaagaccttgagtcaatggggaaaaaggccaatcaaataacgggagcaaaacgggccgggctgtacagaatgctggcatgcgagtacagtcatctgtcttcaaggcatctcgatcttgaaggagcgctttcggatgacaaactggcgaagcagattgccgatgagtttcatgcccgtactgatgacgcggaagtttgccggagggacggcttgcgctaccgcgccgtattgagcggttcagaaaatatgaatacgcaaggcgagagaattgattttccggaccaccatgtgcttctgatcaccggagggacgagagggatcggtcttttatgcgcacgccattttgccgaacattacggagtgaaaaaactggtgcttacaggccgtgagacccttccgccgcgaagtgagtggacgggcggactgaatggggtgacggcttctgtaaaagcgaaaattgaagctgttctcgacttggagtccaaaggtgtacaagtgaaggtattgtcagtcccgttagctgatgaagccgggctgagacaggaattgagtcagatcaaacagacgctcggacctatcggcggcgtgattcactgcgcgggtgtgaccgataaagagacgctcgcattcatcagaaaaaccgatgaagacatacagcgcgtgctcgagccgaaagtagaggggcttcaggcgttatacagtgtgctcagcgaagagccgctgaagtttttcgtcttgttctcttctgtgtcagctgcgataccggcgctttcggcaggacaggccgactatgccatggccaatgcgtatatggactattttgcagactcatacaaagagcagctgccgatcgtaagcattcagtggccgaactggaaagaaaccggaatgggcgaagtaacgaacaaagcttataaagagagcgggctatacagcatcacgaatgcagaaggattacagctccttgacggcatacttcttgaatcagcaaggggcccggtgctgccggccgttctgaatcctaagctgtggaagccggagcgattcctgcggcggagcaggcaggatcagccaatgagcccggctatggtaaaatcggcggaaaaaaccgctgataccgccgcagacaacgctcaattaacaaggaaaacagaagaatggctgaaagaattattttctgaagagctgcggattgaccaggatcagcttgagacagacgtattattccaagattacggagtggactccattatccttgctcagcttctgcagcggatcaatcggaatctctcggcatcgcttgacccgtccattctgtatgaatatccgacgattcaatctttcgcaaaatggcttctcgaagggtatacagaagttttgtcagaacggtttgatttggcggcggctgagcctgttatgaagaagccggctgagccggtaattgtaacacaagccgttaaggtgcaagaagaggcggccgaaaaacagattcaccgggaagatatcgcggtcgtcggcatgtcctgccggtttccgggggcggcttccttagaggcgtactggtcgcttttggctgaaggccgttcggctatcggtcctgttccggctgagcgatggggggtgaagacgccttattacgcgggaatgcttgatggaattcatcaatttgatccggacttctttttactggctgaagaagatgtaaaggcaatggaccctcaagctttggccgctctggaagaatgtcttaacctgtggtatcacgcgggctatacgccggatgagataaagggagaagcaataggtgtgtacctcgggggacgcagccgtcacagaccgggtgaagagaaactgctggatgcgaaaaacccgatcgtcgcgctgggccagaattatttggccgccaatctctctcaatattttgatatgcgcggcccgagtgttgtcctcgatacggcttgttcttctgctttagtcggaatgaatatggccgtgcaggctcttgtaacaggagaaataaaagcggccgtcgtcggcggtgtgagcctgtttgaatcagaagaaacccataaattatttgaacagcgcggcatattaagtaaagcgcagtcgttccatgtatttgacgaacgcgccgatggagtcgtgctgggcgagggtgtcggaatggttcttttaaaaaccgtgtctcaggccattgcagacggagattctatttatgccgtagtgaaggcggcatccgtcaataatgacggaagaacggcaggcccggctacgccgagtctggaagcgcaaaaatccgtcatgaagacggctcttgaaaaaagcggaaaacagccggaagacattactcatattgaagcgaacggttcaggcacggtcgtgacggatctgttagaactgaaggccattcaatccgtctaccgttcaaaagacgccggcccgctcggaatcggatctgtgaaaccgaacatcgggcacccgctttgcgcggaaggaattgcaagtttcataaaggttgttctcatgctgaaagaaaagagctttatcccgtttttatcaggtgagcatgaaaacacacattttgatagagaaaaggccaatattcagttcagccgcactctggcagactggccgtcaccaatgccggcggcaggaattaactgctttgccgacggtggaacaaatgcccacgtcattgtggaagcgtggcagggagacgaagggcgccgaatcaagcgccaccctttaacaccgcctgcattaaataagcggctgatttcgccggacagcaaagaagaaacgaacgaaaaagctgcggcaaacatctgggatacctatgaagtggaggtttaacgtgaagaacttcaataagcaaatcactttatcgctgaaaaatccgtttattttacatcatgacgtttacggacaaaaagtccttccgggattggcttatattgatatgttttatcagatttttaaagagcgcggctattcatacgacgggcttcagctgcgccatttatccatatatcagccgcttatcgcgaaagaagacagcgccgtcaagcttacggttgaatgtacaaaggtaaaagaagggcgctggaaacttaccgcaaaaggggctgaggtcagcggcggacgagtccagccggaagaacgtatttacgtcaaagcggaaatgcacgagacggcacccgcagttttcagtgacacgcttgatcttgactctgtcaaacgcgaggcggaacgcaccatcgatttaaatgagctgtatgcccaatgcagaagccaggaattggttcacagcggatatatgaaagcggaaggagaagtgtttgaggagcgggacggcgtcacctttgatgtatcgctcggaaaagacgcgatgggacaggccgaagggtttttgttccatccgactcttcttgacggaagcggcgtcggcgcaaacctattgatctcctcgctgttaaatggggaaaagaggctgtttctgcctcttttctacgaatcttttacagcttccgaacctttgcaggccggctgcatcacgagaatcaaacgttcgtcgcttcggcaggaaaaagagctcatttacattacactggagttttttaacacatccggccgaaaagtagccgagctgaaagatttcacaagcaagctcgtgcgggatgccgagctgatcaatacagaccgaaagactgctgagaagcctcctgaaaaagtcggtttaccggaagttgcggcatcgcttgaaggcggacacccgcatgaggaagcagaacggtatgtcatgaatctgatggctgaaaaaatcggcaagccgcttgaacagattgattctcaagtcggctactatgaaatggggctgacatcgtccggactgcttgacgtcgtcgaaacgatcagtgaaaaaatcggcgaaaccctttctccgactttgctgtttgaatatacgacggcatcagagctggcggctttcctgacagagcagtacggaagccatttcagcgcgtctcctgcaaaaatagagaagcaggttgagaagcaaacagaaagaagacggaaaagcagtgttccgcaagatgaagatatcgcgattatcggcatggccggccgctatccgcaggccgaaaatattcatgaattctgggaaaacctgaaagaaggaaaaaactgtgtcaccgaaattccggagtctcgctgggactggcgccggtttgaaaatgtaaagtcgccttccggaaagagcatttcaaaatggggcggatttattgatgatccggattgctttgatccccaatttttccggattacgccgcgggaagctgaaacaatggaccctcaggaacggctgtttttacaaacatgctgggaaacgattgaggatgccggatatacgccgaagtcgctcgcagaggcgcgcggacggaataagaggcagcgcgtcggtgtcttcgcaggggtgatgcataaggattatacgttggtcggggctgaagcttcttctgaagatcatgtattcccgctttctcttaattatgcgcaaatcgcaaacagagtttcatatttttgcaattttcacgggccgagcatggctgtcgatacggtctgttcatcctcgctgactgcggttcaccttgctgcggaaagcattcggcgcggggaatgtgaatcggcggttgccggaggggtcaacttgtcgctgcatccgaataaatatctgacatacggtttatgggacatgttttcaacagacggggtttgtcatacattcgggaaagacggagacggctatgtaccggctgaaggaatcggtgccgttttattaaaaccgctgcgagaggcggtaaaagacggagaccggatttatgcggtgataaagggcagtgccgtcaaccacgtggggacagtgagcggaatttccgtgccgagtcctgtcgcgcaggccgatttgattgaagaatgcctggacaaagcgggcatcgatccgcgcacggtcagttatattgaggcgcacgggacgggaacttctctcggcgatccgattgaggttcaaggccttgtcaaggcgttccgccagtacacacaggacaaacagttctgttcgatcggatcagtgaagtccaatatcggccatgcggaatcggcggcgggcatcagcggcttaagcaaggttgccctgcagcttcaccataaaactttggtgccgtctcttcattccgaggagctgaatccgtatttagattttgaacaatcaccgttttacgtccagcatcataccgaagcatggcagcagccatcagtgacggaaaacggaaacgagaccgtatatccccggcgtgcgggcatcagttctttcggggcgacaggttcaaacgtgcatctcattctggaggaatttatccctgaagaatcacggagaacagcgtatgaaccggcagaagaacagactttcattttcccggtttccgcccggaatgaagaacggctaaaagagtatgttgcgaagctgtcttcatttatttatcccggcctgccgcttgaggatgcggcgtatacacttcagatcggccgtgaacagatggaggagcgggttgcgttcaccgctcagaatatgacacagctcaaagagcggctggaaggctttctggcgggtaaaacggtcagcggatgctggcggaaccgagccgataaaagcaatcaggcagagcttgctccggacttgatacataaatggctttcttccgggagtctggagatgattgccgaaaagtggaccggcggaggaacgatggattggaatctcttgtacggtgaaaacaaaccgaatcggatcagcctgccgacatatccgtttgaaaaaatccggtattgggtgccgaaggcggagaaaagagaatcgctgccgcaaaaaagggcaggcatgctgcatccgctccttcatgaaaatgtatcaaacatgtcaggtgttcgtttccggtcctcttttagcggcggagaatttttcctgaaagatcacgtcgtcaaaaacgagcggacgttaccgggcgcggcttatctggaaatggtccgggcggccgttgaacacgcggcagaaacgaaggaagaaggaacagtccgtctgaaaaacgtcgtatggatacgtccgtttacagcggcggatgaatccgcagaactgtatctccgtctttatgatgaagaaaatggggagatgggcttcacggtttacggtgaatcggcttcctcggaacaagagcccgttctctatgcgcaaggaagcgcggcgtttgtccgagggggcgaaccggccaaaatcgagattgacaaattaagagagtcacgccgtctgatcacacctgacgcttgctatcaggcatacaaacagatggggattgaatacggggatgctcacaaagcggtcacggaaatctatgcaaaagacagcaaagtgctcgcgaagctctcactcccgtcatctatttctcatacaaaagatcagtttgtcctccatccgagccttttggatgcggctttccacgcgacaatcgggttaatgcttgacagagacggaaatgacataaggccgatgctgccgtttgctctcgaacagattgatgtgttgaaaagctgtaaaagcgatatgtgggtttccattgcgtacagcggcgaaagcaagccagaagatgccgtgcagaagctggatattgatgtatgtgacgaacaaggcaatgtatgtgtgaaaatgactggttattccgcacgggaaattgaaacggataaaacagatacactattttttgaacacgtatgggaagagaaggccgctgtacatgaaaaagcgccgactcatttcaaagcccgtcacgtgatgatatcagaccggtttacggatcaaatgaacagcatacagacagacttcagctgtcacgtgctccgtgatcagcataagagtgaagacgaacggtttgaagcttgtgcgcttcaggcgttcgaagaagtgaagaaaattctcgcttcaaattccggcgggcgcgagctcattcagattgtcgtgcctcaagaagcggatacgcagctcctttgcggcttaacggggcttttgaaaacagcggcgcttgaaaacccgaacctgaccggccagctgattgaattggagccggacgtcaaggcagacacgctgtcccgatatgtaaaagaatgcagcgctcatcctgatgacaaacatattcgctatgaaaacggcaagcgctatacggcacaatggcaggaaacagggcttgaacagttcggcgccgaaaagccgtggaaggataaaggtgtttatctgatcacaggcggtgcgggcggactcggatttttattcgccaaagaaatcgcccgacatgcaaaagacgccgtgcttattttaacggggcgttctctgttggataaccgtaaaaaagaccagctgcaagaactgtccgatctcggcgcgcaagccgtgtacaaacaaacggacatgacggaaaaacaagaagttcaatcgctcacagcggacatctgccgacagtacggcggattaaacggtatcatacacagcgcgggaacgataaaagacaattatattctgaaaaagcacaaaggtgaaatccgtgatgtgctggcgccgaaagtctccggactggttcatcttgatgaagcggcaaaggacattgagcttgattttctgattcttttctcttccggagccggaagcgccggaagcgcgggccaggctgattatgcgatggccaatgcgttcatgaacgccttcagtgaaaaaagaaaccgtaaaaaagcccgaaatgaacgctatggacacaccctttcaatctgctggccgctttggaaagacggcggcatgacggttgatgctgaaacggaagcgatgctgacaaaagaaagcggcatggtccctatgaaaacagaaaacggcatccatgctttgtaccgcgggtgggcggcaaacacatcccaaatcatggtgacggaaggctacgccgcaaaaatccgggcgtttctgaaaaaatcagcggatgatcagccggataagggcagcgaaacggaagaaccggcaggtcttacggcaggcggagagaacatgcttgcagaaaaaacggagcatttcttgaaacatgtgctttcggaagtaacaaaacttcctgtcggcaaaattgacgccaaggcgcctatggaagattacggaattgattcgattatgattatgcatttgacgggccggctggaaaagagcttcggttcattgtcaaaaacattgtttttcgaatatcagaatatcgaatcgctggcgcagtattttatgaaagcacaccgggacacgctgctggaagtgaccgggctgaaaacagaagaaacctctgcagccaaaccggcgctgtctgaaaaagccgaaataaagcccgtttccaaacggaatgaagccaaaaaaggctttgcgcaagtccgcacagacacgcggaaaaatccagtgacggagcgtgaagatatcgcgattatcggtatatcaggacgatatccgcaagccgaaaatcttcaggaattttggaagaacttgagtgaaggcactgactgcataactgaaattccaaacgatcgctgggatcacagtctttattacgacgctgataaagataaagaaggcaagacgtacggaaaatggggaggatttttgaaagacgtggacaaatttgatccgcaattcttctctatttcgcctcgggatgcaaaattgatggacccgcaggagcggttattcctgcaatgtgtctacgaaacgatggaagatgccggttacacgcgcaaaaagctcacggaaaaatcgggtgatttgcttggcgccaatgtcggtgtttacgtaggcgtcatgtatgaggaatatcagctttacggagccgaagaacaggcgcgcggaaaatcgcttgcgctgaccggaaatccgtcatcaattgcgaacagggcttcctatgtattcggttttaacggtccgagcatggcgctggatacgatgtgctcttcttctttaacagccattcatctggcatgccaaagcttgcggaacggggaatgcgagacagcatttgccgggggcgtcaatgtatccgttcatccgaataaatatttgatgctcggccagaacagatttttatcaagcaaaggcagatgtgaaagtttcggtgaaggcggggacggttatgtgcccggtgaaggagtgggagcggtactccttaagccgctttctaaagcgaaagcggacggtgatcatatttacggcctgatcaaaggaacggccgtaaaccatgatggaaaaacaaacgggtattccgtaccgaatccgaacgcccaagccgcggtgatcaaacaggcgttaaaagacgcgggaaccgatccgagggcagtcagctacatcgaagcccacggcaccgggacttcactcggtgatccgattgaaatcacgggtctgacaaaagccttttcagaacaaacacaagataaacagttttgtgccatcggctcagcaaaatccaatatcgggcactgtgaaagcgcggcgggcatcgcgggtctgacgaaggtgctcctgcaaatgaaacataagaagctcgcaccgtcactgcattcccggacgcttaacccgaatattgattttctcgctacgccgtttatagtgcagcagacgcttgaagagtggaaaagaccggtcataaatgaaaacggaataaataaagaactgccgagaaccgcggggctttcctcattcggagccgggggcgtcaacgctcatatcgtcatcgaagaatataccgctgatgaggataaggagacggcttttgccgctcctcatccatcgatgatcgtcctttccgcgaaaaatgaacaaaggcttcaaaaacgggcggaacgtcttcttgatgcgctgcggagcgggcgttaccaagaagcggatctgagccggatcgcatatacgcttcaaatcggacgtgaaccgatggaagagcgtctcggaatgattgtcagcaatttgcgcgagcttgaagaaaagcttgacgaatttacgggcggcaaggagtcaattgaccggctctaccgcggacaagtcaaacagaataaagacacgatggcgctgtttgcggctgatgaggacatggaaaaaaccattgaggcatggcttgaaaaaggcaaagccgcaaaggtattagagctttgggtgaagggccttccgctgaattgggataagctgtatcaaatgggcagaccgcaaaaaatcagtctcccggcctacccgtttgcaaaagaccgttattggatcgacacatcagctgatgcagctgtcaaaagaccggccgaaacacagtctgcgccgatcgcaccggcggccgtcccggaaccggtcattgaagtagcaactcttcacgaggagactgccaaagaaaaaccgtcaaacatttcattgcagcctttgagcggcgcgaaaccgaaaagaaccgtacagtctgcttcccgtccggcggtatccgctgaaaaagtaagtgccgaattaacggaaaggttggcggacgtgttatatatggatgccgacgatatcgacgcagatgacacatttattgatatcggcatggattcaatcacaggtcttgaatggataaaggccgttaataaagcgtacggcacgtcccttacggtgacgaaagtatatgattatccgacaatccgccagtttgcggccttcttgcaaaaagaactcgggacagaaccgatccttgaggaagcagccgaaccgcagaaaacagaggccgtaaaaaaaccgtcaaacatactgctgcagcctttaaacgctcataagcagcatgtgatacaagcagaagcggatattctggaggcgatgtctgaaacggcagcttccgccgaaccggaagaaccgattgaagcggtgcatgacgagttatcaaaagcactggctgatgtattgtacatggagcggcatgaagtggatattgatgaggcctttattgacctcggtatggattcgattaccggtcttgaatggataaaggccgtcaataaacggtacggcacggactgtaacgtaacgaaagtgtatgattatccgacaatccgtcaatttgccgattttctgcgtacgcagccgtccgtccgcggcagaaaaaaacaggcggttcccgtacgtccaaagccgcttacacagcaagccgccccgcaggagaaaacacctgccgagccggagagattaacggttcaaaaggaacctgaaccggtgcaggccaaacgggagcctaaagacgagatagcggacgcgatagccatagttggcatgtcgggcaagtacccggatgcgccggacctaaaggcatattgggacaacttagcccgtgcgaaaaacgctatccgcgacatcccgctttcccgctgggatgtaaacaaatactatgatccggccttaaacaagaagggcaaagtatactgcagatcaatcggtatgcttgacggcattgaagagtttgatccgctgttctttaatatttctccgtctgaagcggaacttatggacccgcagcaccggatatttttacaggaaggttttaaagcctttgaagatgcgggttacagctcaaaagaattaaacggaaaaaattgcggcgtttatttggggattatgaacaatgaatacggaatgatgttaaacaaacatcagacaggaggaagcgcgacgggcaacagtttcagcatcgcggcggcccgcctgccttattatctcaatttgaaagggccggccattccgatcgatacggcatgctcttcatctctcgtcgggactcatttggcgcgtcaggcgctgttgaatcatgaaattgacatggcccttgtcggcggcgtcaccttgtatttaacgcctgaatcatacatcagcatgtgtgaagccggaatgctgtctcctgacggccaatgtaaagcatttgataacagtgcgaacggatttgtgcctggcgaaggcgcgggggcgctcgttttgaagaggctgaaagatgcggaagccgatcaagaccatatttacggagtcattatcggatctggaattaaccaagacggaaaaaccaacggcattaccgcaccaagcgcgaaaagccaaatggatttagagcgtcaagtgtatgaagcgcacaacatccaccctgagagcatcacctatgcggaaatgcacggcaccggcacaaagcaggggatccgattgaattagaagccttatcttctgtattcaaggaaaaaacggaccgcaaacaattttgcgccatcggttcggttaaatcgaatatcgggcatacgtcggcggcggcaggtgtagcaagcgtacagaaggttctgctgtcgatgaagcaccagcagcttgtgccgacccttcatttcagcacgccgaatgaacattttgatttcgatgactcgcctttatttgtcaataccgaacttaaaccttgggaaacaggcggagcaccgcggcgggcctgcgtcagctcattcggctacagcggcacaaacgctcatctcgttatcgaagagtatcagccgaaagaccggggaagccgcaagtctgatgagacaaacatttttgtgctgtcggcgaaaaaagcgccgcaggtaaaaacctatgctgagtctgtgatcgaatttgcaaaagccaatcagaatatcaatctttcggatatggcatacacgcttcagaccgggcgtgatgcgatggattaccgtcttgcggttacagccggttcgagagaagaactgatcagccgtttaaccgattttgtaaacggaaatacgggtgaagggatatatgaagcccacatcaaaacggcaaaaaaagaaatcaaagcatttgaaacggacgatgatctgaagcagcttgtcaggtcgtggttcgataagaaaaaatacgccaaaatagcggaattgtgggccaaagggcttcagacggactgggacagactctatcaaggcgaaaaaccccgcagaatcagtctgccggcttacccatttgcgaaggagccgtactggctgcctgagccgaaagccgtaccgcaggaaacagaagaccggcgcaaggctgtgcttttagaaaagcaatgggttccgtgtgagatcgattcggccggtgagaaaagcggcaggacggtcatgattctggctgatgcaagaacagcggaacttgccgaagagactgcgaagcatttcgctgactcgttcattctcccggccgctgacactgcagctagcgattggaatcacatagatggcgtaatcgatctgacgggatgcggagacgaagacccttcactggaagggatcagccggctccagactctgattgatacaagccgccggcaagcgcggccgctgacgctgctatatgtaacaaaaggcttggagccatttcagcagaaaacgattcatcttgcaggagcggcaaaaagcggcctgtacagaatgcttcaaaatgagtatcaaaacgtgacgtccagacacatggataccgatacagatacggatcagcagacgcttgccaaacagattgcagatgaattttcggcggacagcacagaaccggaagtctgccgccgaaacggacaaagataccgtgctttgttcagcgagattccaagcgggaagcgagcagaacataagccagcaccgtttcctgaagaccatgtgcttttcattaccggagggacgaggggactgggtctcttatgcgcccgccatttcacagaaaaacacggcgtgaaaaaagtagtgctgacaggcagggagccgattcctccccgtcataaacggacagccgttaatatgaggctgagagagaagatacgggcgattgaagagcttgaagcaaaaggagtgcaagtggcggtgatcagtctgaaattgtctgatcatgacgcggcggcagcggaaattgaaacgatccggcgcacgatgggaccgatcggcggcgtcattcactgtgcgggatcggttaattcagtaaatccggcgtttatcagaaagactgccgacgacatacaagaagtgcttgaaccgaaagtcgccgggcttcaaacattaagcagccttttcacaaatgatcctttgcaattttttgtcttattttcttcagtatctgcagtcgttccggcactcgcggcgggacagtcggattatgcgatggcaaatgcgtacatggattatttcgcggcggctcatcagcatcaatatccgttagtcagcattcaatggccgaactggaaggaaaccggattgggtgaaatccgcacagaaaacctgaagcagaccgggctgctgggactgtccaacgcggaaggacttgacttgctggaccgcattttatctgaaaacatccgcccgtccgttctgccggctatcgttgatcggagcgaatggcatcccgacaggctgctctgtcaagagaaaaaacaaaaagagactgaagccgtaataaacggcaaagacgcggaaaaacattcagacagagaactgcttcttgatacgaaggcatggcttgtgaaactgttttccgatgagctgaaaatcgctccggaagatctggaaacagacgaaccgtttcaggattacggggttgattcgatcattttagcgcagcttttacagcaaatgaatcaagcgctcaaagaggacttagatccgtctgttttatatgaacatccgacgattgacgcgtttgccgaatggcttgtatccaatgggcagccgctgcttgcagaaagggaggaacctgatacggaaatgttggttccggctgccgtacaaacggttcacactgagcaaaagcgtgctgctgtaactgaagacattgccgtcgtcggaatgagctgccgttttccgggagcggaatcgttagaacaatattgggacttgctgagaagcggcaggtccgcaatcggctccgtcccggcggaacgtttcggatatgcaaatcaatatgttgcgggattgattgacaatatggatcactttgattccgaattctttttcattccggaaaacgacgcgaaagcgatggaccctcaggcgttggcggtgctggaagagagcttgaaactttggtgccatgccggctatacccgtgaagaaatcaagggcatagaagccggtgtgtatatcggaggccgcagccagcatcagcctgatcctgaaagtcttgcgaatacccgcaacccgattgttgcgggcgggcagaattatttagcggcaaacgtttcgcaattttttgatctgcgcgggccgagtatcgtgcttgatacggcttgttcatcagctttgacaggaatgaacatggccgttcaggcactgagaagcggcgatatcaaagcggcggtagttggcggcgtcagcctgctgaacacggatgcggcgcaccggatgttccaagagcgcgggctgttaaacgagaaaccggcatttcacgtatttgacaagcgttcaggcggagtggtcctcggtgaaggcgtcggcatggtgctgttaaaaacagtaagccaggcgcaaaaagacggcgatacgatacacgcggtcattaaggctgccgccatgaacaatgacggcagaacggcaggcccgtcagccccgaatatgcaggcgcaaaaagacgttatgcaaagcgcgcttctcaaaagcggcaaaaagccggaagacatcacttatatcgaagcaaacggatcgggttccgcggtgactgatttgcttgagctgaaggcgattcaatccgtataccgctcaggtcagcatgttccgctcggcatcgggtcaatcaagccgaacatcgggcatccgctttgcgcagaaggcattgcaagcttcattaaagtcgtattaatgctgaagcataaacaaacggttccgtttctctcaggagacgaaccgatgccgcattttgatataacaaagacagattttcactttcataaaacagccggcgaatgggatgcagccagaccgtcagcagccatcaactgctttgccgacggcggaacgaacgcccacgtcattctggaagcttgggaagaaaaagatacccgaatgaaaagaaagccgctgccggtaccgtcattaagacgtaaggctctggtaaaagaacctgacgtacgagcggagaaacaagagcttcctgcgaaaaaaatgttttggaaagcatttaaataagagaggagtgggaaggaatgatatcggaaaaaatcaatatctcactggatcatcccatcatgaagggccatatggtctttggtgaagcggtattgcccggtcttgcttatatcgatttgatttatcaggtttttcaggaacacggttatgtatacaatgagcttgaattgaagcacgttacgatttatcagcctttaaccgtcagtgaaacggctgcaatcattctgaccattcaatgttctgatagcggagatggaaagtggctcatctccctttcagggcagaaacagcaaggtgacgagctgtcagacaatatacaatatgcgacggctgaaatggtgaaaagagacgctgtcacatttgacgaaatcattgatttcagcgatgtgaagcagtcagccaggtctctgaatcttgatgatatgtataaccgctgtctggatcatgacttggttcattccggcatgatgaaatcaaatggacaattgtacgaaacagaaagcggcatgctggctgagctttcttgcgaagaaggaaaagatttctttttattccatccggcccttttggatgcgagcggaatcggggggagcggtttgctttcagaaacaaaccggcttcacctgcctttatattatgaatcgttcacggccgctgacaggcttcaatcagagtgcacggcgcgtatcgccgcttccggcgtccgtcaggaaaaagaactcacaacgatgacgatcgagtacttcagccgatccggacaaaaggtggcggagcttaaaaacattacgggaaaagcggttcggctcgaagacgcgaatacagccgaacagaatcaacaggctgcagctgagccggaaagcgcagatgaaaaagacatcattctgtttttaaagaagcttttggctgataagcttgggcaaccttgggagacgctggacgttcttgcaggctactacgagcttggactgaattcatcttctttgcttgagattgtacaggatatcagtaaaaagacgggtgctgacctcgcgcccactcttctctttgaatatacaaatataaaagaactcgcagcctttctgaaaaagactggttcatttgaatatgcggaggaacgtgcagccgaatcatcacgatctgaagctgaagcgccggacgcgccagaacatcataaaaacaccggagacatcgcgattatcggaatggccggccgctatccgaaagcgaaaagtgtggcggagttttgggaaaaccttaaggcaggcaccgattgcatcactgaagttccgaagtcccgatgggattggaaaacatatcaaaacgtaacgtccccgtctggaaaaacagtatcaaaatggggcggtttcattgacgatgccgactgtttcgatccgcagtttttcagaatctcaccgcgtgaggcggaaacgatggatccgcaggagcgcctgtttttagaaacatgctgggaaacgattgaagatgcggggtatacgcctgaaacgctggggaataaaggggagaaacagcatccgatcggcgtatttgcaggggtgatgcataaagattattccttaatcggcgcagaacaattatctgaagctgatccttttccggtttcactgaattatgcgcagatcgccaacagagtgtcctattattgtgacttccacgggccgagcatcgcggtggataccgtttgttcctcatcattgaccgccgttcatctggccattgaaagcatccgccgcggcgaatgtgaagccgcgcttgcgggaggggtgaacttgtcgctgcacccggcgaaatatctcagctacggaagcgtagggatgcactcaagtgacggccgctgccgcacattcggcgagggcggggacggctacgtttccggagaaggagtcggtgcggtcttgctcaagccgctggaaaaagccgaacaagacggcgaccgcatttacgcggtcattaaaggaagcgccgttaaccacgtcgggaaagtaagcggaattaccgtcccgagtcctgctgcacaggcagaagtcattaaggcctgtctgaaaaaagcaggtatcagcccgcggaccgtcagttatgtggaagcccatggcacgggtacttcgttaggagacccgattgaaattgaaggtctgtcaaaagcgttcagccaagggacgcaggatcagcaattttgttccatcggttcggtcaaatcaaatatcggtcacgcagaatcagcggcggggatcagcgggttaacaaaagcggcgctgcagcttcatcacaaaacgcttgtcaaatcactgcattctgcggaattaaatccttacctgaaatttgagggatctcctttttacgtacagcagcagactgctccgtggaagcagccggcagccgaagaaaacggaaaagtcacacattatccgcgccgggccggactcagttccttcggtgcatcaggttcgaacgcccatatcattttagaagaatacattcagcctgaacaaaaagcgcctgcacctgagaacaatgcagcaaaactcatcccgctgtcagcaagaaataaagacaggcttctggcctatgcggaaaaactagcccgatcgctttcagaaaagacggtgctgtctgaactggcttatacacttcagacaggacgtgaagcaatggaagagagagctgtcttccttgtaaatgacatccgcgacttgaaagaaaagctgaatgatttcgtaaaaggaaacgaaaacatccccggtctttggcgcggacaagccgagctgccggaactgagcgaaaccgctcccgagacggatgatccgatacggcttgccgagttatgggcagaagggaaaataatagattggaataggctgtacgcttcgggtaaaccgcgtaaaacaagcgttccgacgtatccgtttgcaaaagaacgctattggattccgcagcagaaaaaacaggagaaaagcccgtcaggcacagtgctgcatccgcttttacaagaaaacacgtcagatttttcgcagcagcgcttcacgtctctttttactggagatgaatttttcctatctgaccatgtcgtcaacggacaaaaaatactgccgggcgttgcctatttggaaatggccagagaggcggttaaaaaggctgctgccgtgacggaaaaagaccatagcgtcacactcaggcaggttgtttgggtccggccggtcatgattgaagacaaaccgaaggaaatacatattgccctttacccagaagataatggtgagattacctatgaaatatacagtgaggcagaaaacggcgaagatccggttattcacagccagggtgaagcggtcattaccgaaccggaaagcgcccagattgatatcgagtctgtcaaagcttcctgcaattcagggaccgtgactgcggaagaatgttacggtgcttttgagaagatcggtctggattacggagaggcatacagaggcgtacagcaattgctgatcggagaagaccgattattggcccgtatttcactcccggctgccgtacatgacaataaagaacagtatacgcttcacccgagtatgatggacgccgcttttcacgcctccgtcggtctgcttgtccgctcaatacatgacgatgcagacagccacgagctttctctgccgtttgcgatgcaggaagtggaagtgttcgggccgtgtcctgaacatatctggtcatatatccggtacacagaaggcagcaaagcagatgacaacgtaagaaaatttgacattgatatgtgcgatgatgccggtacggtttatgtccggatgaaaggcgcgtccgtccgggcgcttgacacaggccaaacagcgggcggagaaaccccggaagcgcctgtcggccatacgatgctgattccggcatgggagcccgttgcacttgaaaaaacgaagaaagcaaaaacagcggaaaagcagactgcggttttcggtgaaactgacagaacgcatacgcgcataaaagaacatctgccgaacgcttcctattatccgatcagaggtacggatgatatcacatctcttacgtacatgcttgaaggacaaaaagagctggagcaaatcatttggcttgctccgcaggctgagagtgcttgcagcctcaaggaacaggaaagaaacgttcttcatgtgttcaagctgatgaaagcattacttgccttggggtacggagaaaaacatttggactggtgcatcgtcacagcaaatgcccagccgttttccgatcaagacagcgccgccccgtcacaggccgcagtcagcggacttgccggaacaatggcgaaagaatatccgcattggaatatccgcatgattgacacggaaacggacggcagctggccggtcaaagaggcgctcagtctttctgccggaaaaaacggtcaaatttgggcgtaccgcaatcagcagctgtttgagcggcagctgataccgcttgacaatatgccgaaaaacggcacgctgtaccaaacaggcggggtttatgccgtgatcggaggcgccggatatcttggcgaggcatggagtgaatacatgatccgccgctacaaagcacatatcatttggatcggaagaagcacactgaatgattccatacaggcgaaactcgaccggctcagcgcattcggcccggcgcctgaatatgtttccgccgatgccgctgacagtgcttccttagagcgggcttatcagttcataaaagagcgtcacacaaaaatgaacggaatcatccactcggcaatggatctgtctgagcaaagcttaaataatatgaagacagaagagttcaaatcggtgctgcgggcaaaagccgatgtcagtgtgtccatggcggaggtatttggacgggagccgcttgactttgcgctcttcttctcctcgcttgtggcatttatccataacgtgaaacaaagccactatgccgcaggatgcgctttcagtgacgcatttgcgaaagaacttgatcagacgtggaattgtccggtcaaagtcatgaattggggctattggggcaacagcgaagcggctgaagacggcgattttattcagctgatggatcagatcggattgggattgatcgaaccggacgctgcgatggaggcgcttgaaacccttatgacgctgccggttgatcaagcagctttcattcatacgacaaaaccggtcgcagtcgaagggatgagtgaaacagaaaaaatttccgtttatccgtctcagccgcttgtctcttcacaacagctgaaggccgctccgcccggcgcacgtcttgtaaaagaggctgaacatcaaaagctcgatgattttctgtatcggcttttgatcgcccagcttaaagaagcagacttgctgacgccgcaaagccttaaagcgtatgagcccgaacacgaatattttaaaaaatggctcaatcaaacgatcgctttccttctggaacatggttatctggaagggaatgcggattcatataaactgtcggcccgtgccgaagacacaaccgcctcgctatggcaaaaatgggagcaggaaaaagaggaatggctcaataacgccgatacaaaagcgatgactgttttagccgagacgatgcttaaagcactgccggacattctgcgcgaagacgtgccggcgactgacatcatgttcccgcactcttcaatggaacttgttgaaggaatttataagcacaatcaagtcgcggattactttaacagcgccctgtcagaaacattaacggcttatgtgaaagaaaacatcagcaaacattcaaaagccgagatccgcatactggaaatcggagcgggcacaggcggcacaagcgcaggcatatttgaaaagcttaggccgtatcaaaaccatataaaagaatactgttacaccgatgtatcgaaagcttttctcgtgcatgcggagacggaatacggcaaacggaatccttatctgacgtataagctttttaacgcagaagcgccgcttgccggccaggacatagagccgggcgcatacgacatcgtcgttgccgccaatgtgctccacgcgacgaaagacatccgccagacgctgagaaacgctaaagccgtcttaaaagacaacggtttgctgctcttaaatgaaatggcgggaaacagcctgttcccgcatattactttcggactgcttgaaggctggtggctgcatgaagattctgcccttcgtattccggggtgcccgggcttgtatccggaaagctggaagcgcgtgttagaaagtgaaggctggcattctgtcttcttcccggcagaagcggcacatgaattaagccatcagattatagcggcaaaaagcaacggcgttgtccgccaaaaaacgcttaaagcaggggccggaaaacggaccgctccgccaaaagcagcacaagcgccggaatttaaagcgccgcaaacaacggtgcaaaaaggcgacacgtctttaacagaaaaaagcaccgagtacttgaaaacgttaatcggagaaacgttaaaaattccgccggctcaaattgatccgaaagcgccgcttgaaaaatacggaattgattctatcgtcgtcgtacagctgacaaacgcgttacgaaatgtattggaccaagtcagcagcactttattttttgaatatcagacgatcgaagcgctcgtcgctcacttaatcaaaacgaaaaaagacgcgatgatcaaactgacgggacaaacgcctgttcaggaagaacggaaggcatcaccagaaccgcaggctgtacagccggccaagccgcttcgcactgactggcggcggagggaaaagcgggcagccagagagaccgtccggcaaagttcggttcgcgacgtggccatcatcggtgtttcaggacgctacccgcaggcaaaaacagcggctgagctttgggccaatattaaaaaaggaaaaaactgcatagaagaaattccgcaggaacgctggaactggcaggattactacgatgaagagaaaggtaaagaaggctctatttatacgaaatggggcggcttcattgaggatatggacaagtttgatccgctgttctttcagatttctcctttggaagcggagcgaatggacccgcaggagcgattatttctagaaacggcgtatgcgagtatcgaggatgccggctatacgcctgacaacctgtgccaaagcagaaaaattggtgtttttgccggcgcgatgaacaaaaactacccgacaggctacggctactggtccattgccaacagggtatcttacctttttgatttccaagggccgagcattgccgttgatacagcctgctcctcttctttgacagccattcatctggcgcttgagagcatatacagcggttcaagcgaatgcgcgattgccgggggcgtaaacatagtgaccgacccgattcattatatgaatctgtcagtcatgaacatgctttccgcaagcgacacgtgcaaatcgttcggagaccgcgcggacggttttgtagacggagaaggggtgggcgcggtcgtattaaagccgttggagcaagcgattgccgacaacgatcacatttacggtgtgattaaaggaagcgccattaacagcggaggcaaaacgaacggatacaccgttccgaatccgaatgcgcaggccgccttaataaaagaagctttcgaaagggcaaacgtcccggcgcgcaccgtcagttatattgaagcccacggcacggggaccgcattaggggatccgattgaaatcgccggattaacgaaagcatttgatgaggatacaacagacaaacagttttgcgccatcggctcagcaaaatcaaatatcggccattgcgaaagcgcagcgggcattgcgggtctgacaaaaatattattccagctcaaagaccgccaaattgcgccgtccctgcacgcggaacagctgaacccaaatattgatttcgcgtatacgccgtttgccgttcagcaggagctcggtgagtggaaacgtcccgtcatcggcggcaaagagcttccgagaagggcggggttaagcagcttcggcgcgggaggagcaaacgcccacctcatcatagaagaatatacggcagacaaagagcctgatgagacgccggcagatcagcccgccatcatcgtcctgtccgcgaaaaacagcgaacggctcactgaaaaagcaaaacagctcagagacgccatccgtgaaaaaagatacagcggccgcgatcttatgagcatagcctttactctccagactggccgggtgccgatggaagagcgtctcggttttatcgtccattcacttcatgaacttgaggaaaaactgaacggatttatcgccggacaaaacagcgccggactgcaccgtgacggcacggaagaaaacaaacggatgcttgccgtatttgcggccgatgatgacatggaaaccatcatagacgcttggatcagcaaacggaaatattctaagctgcttgagctttgggtaaaaggattggacatcaattgggcgaaattatacggagaccgtcctccggcccgcatcagcctgcctgcttatccgtttgcgaaagaacgcttctggcatcagcagcctgtacaaagcaaggccgcgcccgttaaggcgccggctgatgaaagtgatccggcggagcagtttgaagtaatggcttttagagaagttcttaaagaacaggctctgccggctgccggagaaaagcaagtcaaaacggtgatttctttcttaactgatcagaagaagcagcaggaagccgtctctgtgatcaaatcgtatgacagtgacattgacgttatttttatcgctcagggagaccggtatgaggccttgtccgccggccgctgccaagtggtgcgggaagatccgcaatcatatgtgaacgcttttgcggatattcaaaaagagtacggtgaagcttctgccattttgtatttatgggcgcttgaagataaaagctgcatcgaagattattcatgtattgtccatattctcaaagcaatggctgagaccggtctgcagccggaaaggctgttattggcgggggaatatgcatccggtctggaaaggtgctacttggaatcatggatcggctttgagcgttcgctcggcattgttcttccgaaaacaagtgttaccggccacttccgaaaagccggcgcggccataacggactggatgagaaccatttgggacgagctgaaagctgaaacagaccataccgttttcttggaagagggaaaacgatatgtctatcacaccgaaccaaccggactaacgaaagaaaacggcaggatcagaaccggcggaacatatctcattacaggcggattaggagggctcggctacttatttgcccgccatctcgcccggaactaccaggcaaatgtcattctcacggggcggtcgccgatcaatgaagaaaagaaagaaaaaatgaaagacctggaaaatctcggcgcgggtgttctttacgccgaagccgatgtttgtgatccgatcggaatgggcgactgcatcaagcgcgcgaaagaacgattcggagctattcacggcgtcattcatgcggcgggcatcgaaagcagaacatccgtctttgaaaatgaaatcaggaatttccgcagtacgcttgaaccgaaaataaacgggagcctgcttcttgacgagtggctgaaaaacgaaacgcctgatttcatctgctacttttcatccacatctgctgttttaggagattttggatgctgtgattacgcggtcgcgaacaggttccaaatggcgtatgcccgctataaaaacgaacaatccgaaagcggaaacgcttttgtcataaactggccggtctggaaaaacggcggaatggccgtcggcggtgaagagacgacgggcatgtacctgcaatcaagcggacagcgcctgttagaaacagatgaaggcattgagctgtttgagcgcatcatttctcaagacaacacccagtgccttgtcattgccggcaaaagaagccgcgccgaacgatttttaggcatacggcgggacgattcatcaaaaccggatgcgcttttggaaaccgtgagccgccgcatcccggaagaaagcacggaaaaacggctcgaagcggatttgaaagagctgatacacagtctgctgaaaatatctaaagataaactcgtcctgcataaaaactgggcggaattcggatttgattccatctatttagccaaatttgccgctcttttgtcgagtcattacggcattgaagtcactccggctttattttacagctatgccacgctcggagacgtcatcagctattacctgacagaacacaaagaaacgatcaaaacgttttaccgaacggaagaaactgaaacaaaagccgccgctccgggtaacaaggagtacacggatcaggagatcatcgccatgatgaaacaggtctctgaggggacattagattttaaaagagtgcaagacatcatagaagggagtaagacttatgaatcataaagaacttctcgatgcctacagatcaggaacgctcaccatcgctgaagtagaacaaaagcttcaggctttcaagcggacaactgcaaaacgtccgctttctgaaggccagaaaggtttgtggatgcttcagaaaatgtttccggagatgagcgcatataacattccgttatgctttcgttttcaaaagctggatatcgagacattcaaaaacgcccttttgtccgtgcagcgccagcaccctattttgaccagtgtgataaaagaggaaaacggccttccgtatcagatagaagatacggatcggcattttccgattgaagaaatggatctttctgaattaagcgggcgtgacgctctttcgtttattaaagaaaaagcaaaagaaccgttcgcgcttgaaaccgggccgctcctgcgtgttcatgtattccggcgggcgaagcgggagccgattgtgttaatcaccattcaccatattatttttgacggcgtctctcttatgacgtttatgtcggcgctgctggacgcttatgtaaaagcaagtgaaggcaaagaacctgtcatggttcagcaggccgcagattatcatgactttgtgaaatgggaaaaagagctgctggaaagcgaagcgggaaaaacgcatctctcttattggaaaaagcagctggaaggaccgctgccggtgcttgagcttccgtcggattatccgagatcatcggttcaaacttgcaaagggcaggcgtatcagcgcttgcttcctgatgaactgaaccggcagattaaagtgtgcgcccaaaaacataatgtcaatgaatccgttgtgtatctcgctattttcaaagggctgctctatcaatatacgaatcaggaagatgtcatcgtcggcatgccgacgatggggcgctctgaggctcaatttgaatctgtcatcggatactttattaatatgatcgcggtcagaagcagggagacgggcgccaaatcctttacggcgtttttgaaggagctgcagctgacactggcagaagggctggaccatgccgcgtatccgtttcccgcgcttgtcaaagaattgaagacggaacgctcgcctgcggtttcgcctgtttttcaaaccgcgtttttctatcaaaacttcttccggacagaaggagcggaaaagctggcggaactatatcaatcactcggcattgaaatgatagaagacattcatcaggaaggcgaatttgagcttgcgcttgaagtctataaaaaagaaacgggaaccgtcctgcaatttctgtacaacccggatgtctacagcccttctttcatcgaacggatggcggagcattatatgaaactggcagaaaaggtgctttctgatccggagatcgcttttgaagcctgttccggcctgctcaatcaaaaacgtgaagcaagccgatctcatcagccgaatgagcgctgcattcatgaagtgtttgcggaaaaagccggacgccaccctgacagagaagccgtcacatacggtgaaaacagtcttacatatcgcgaattagatgaacgaagcacggcgctcgccgtgtacctgcaagaaaagggcgtcacaccggaatgcccggtcggcatttgtacggagcgttcttttgagatggtcatcggcatcctcgccattttaaaagcgggaggcgcgtatgtgccgctggacccggcttttccaaacgaacggatggcgcacgtgttgactgacagcggcgtttcaatcgtattaacgcaagcaaatacgcgcggcatgattgaacagttggccgtcggcggtgtgagcacggtggaaattgaaaagagcggacgttctgtcagcggggcaaaactgacgccgcgttcaaaaccgcatcatctcgcttatattctatatacgtccggaagcacgggaaaaccgaaaggcgtcatggttgagcacagggccatcatgaatacgctgcagtttttggaagctgagtatccggtcgcgcaagaggatgcctatttgttaaaaacgaattacgtatttgacgtttcgatttctgaattattcggctggtttatcggaaacggacggcttgtcattttgccgcctggtgcagaaaaaaacccgcagctttgtatggaatacatccaaacccaccaggtcacgcatctgaattttgctcccgccgtgtttaatgtatttctggaaacggtaaagcggcatacggcatttacagaagacggccctgtgaaatatgtgatggtggccggtgaggcatttccgaaagatttagtaaaaaaggccgtttccatcttcaaacatgccagaattgaaaacatatacggcccgacggaaacatctatttatgccgcttactacagctgcggccaaaaggaaatcacaagcaggaatacgccgatcgggaaaccgattcaaaatacacggctttatattgtcgatgaaaagctcagccccgtccctgacggtgtggccggcgagctttgcgtggccggcgccggtctggccagaggctattacaatcagcctgagctgacggcggcatcatttattgataatccgtttagtgaaggagaaaagctttacaagacaggtgatttggccagatggctgcctgacggaaatatagaatatgctggccggattgacagtcaggtgaaaattcgcggcttccgcatcgaattgggagcgattgaaacgaaattgaacgaacatccggacattcttgatcaggcggttgttgttcaggaaaagaacggacataaaaagctgattgcttattatacggcccgctccggtcatacggcagatgaaaaagcgctccgcaaccatcttttatcgagtctgccggattatatggcgcctgcccattttatccgtctggatgcgctgccgttaacaccgagcggaaaagtgaaccgcaaagacctaaaacagcgcaaggtaattgttcaccggtctgaaaagacgggcagactgccgttatcagaagcggaagcgaaagtgaccgcaatatgggaagacctgctgaatacggcgggcatcaaaaccgaagacggctttttcgatgtgggaggcgactcgcttttggctgttgcggcggcagaacgcattaaacaggagctggaatgcgattttaccgtcacggatttattcgaacactctaccattcaggcgatcagccgatttattgttgaaactaaacaggcggctgaatcagaggcatcaggccaagatgagagagaaagagaacaaacaccgcaaaacggggtgccgtcttactttgacgacagtgtggcgatagtggggatttcctgccagttccccggcgcgaaaaatcatcatgagttttggaagcagttaagagaaggaaaggaaagcgtccggttctactcggaagaagaacttcgggaagccggcgtacctgaagatttgatcgaaaatcccgactatgtgccggcattatcgacgatagaaggaaaagatctctttgaccctgagttctttcacatttctccgaaagacgcagaatttatggatcctcagcttcggcttctgctgctacattcttggaaagccgtcgaggacgcgggatatgtatccaaagagattccgaagacaagcgtatatatgtcggcaagcaataattcgtatcggtcgcttttaccggaaaaaacgacagaaggccatgaatctcctgacggctatgtctcatgggtgttagcgcagagcggcacgattccgacgatggtttcccataagctcggattaaaagggccaagctatttcgttcattccaattgctcatcatcattagtcggtctttattcagcctataaaagcatcacgagcggagaatcggaatacgcgctcgtcggcggagcaacgctgcatgcagcgacaagcatcggctatgtgcaccaaaacggattgaatttttcaagcgacgggcatgtcaaggcatttgacgcttcagccgacggtatggcgggcggagaaggagctgccgtcattctgctgaaaaaggcgtcgcaagccgttcaggacggagatcacatatacgccatgctcagaggcatcggtctgaacaatgacggagcggataaagtcggtttttacgcaccgagtgtaaaaggtcagactgacgtcatccagcatgttttagacagcacgaatattcacccggagacgatttcctatatcgaagcgcacggcacaggaacgacattgggtgatccgattgaaatgtccgcgctgcagcaagtgtataaacgttacacggaccgggagcagtattgcggaatcggctccgtaaaaacgaatatcgggcatttggatacagcagcgggtctggccgggtgcatcaaagtcgccatgagtttatatcatcgggagctggcgcctaccattaattacacgtcaccgaatccgaatatcaaattcagcggttcgccgttttatgtggcggataagagaaaatcgcttccggagagagagacgccgcaccgggcagcgttaagctcattcggactcggaggaacaaacgcacacgccatttttgaacagtatgaaaacaaaacgatcagcggatcaaatgacggacagccgccttatatcgttccgctgtcagcgagaaataagcaacgtcttactgcctatgcaacttgtttatccggctttctggatgaagccgaaaacgatgtttccttgcatgatctggcatttacgtatcagaccggacgtgaagcgatggaagagagagccgtttttatcagtcatgatcgtcacgatctgaagcgtcagctgcaggatttcatcaacggcaatgaccaaaacatcttacggggcgaaaaagtgagaagcagagaagtgtcggctcaggagatggaagagcttgcggcatgtcagacacgtgatgaaaagctgaaagcacttgcggcgctctggattgaaggagcgcgtgttgattggggcttattgtatcaggattccgcgccgcgaagaatcagtgcgccgacctacccgttcgcagaggagcgcttctggccggaagaaactgtgaagcaaacagatgcgaagtttttgcatccgctggtacatcagaatacatccgtcttgcaggagcagcggttcagttcggaatttacgggaaaagagtattttattgccgagcatatcattaaaggaatggcgatcgtgccggctgccgtcacccttgagatggcacgggccgcggcggagaaaagcatcggcggggcaacagaggattctctcggcctgcgcttaaagaatatcgtatgggtccgcccggtgatagtcgatcaggacgctgtccgtgtccatatcggactttatgaagaaggggacggacagattcaatacagaatgtacggcggtaacgattctatcggtgaagaagctcctctttataatcagggcatcgctgaaatcatccggaaggaaccggaggaagcggcggatattgagcagctgaagcgccggtgcacgcagggaacaatcgaatctcaagcgttttacaaaggaatgatcggagctgattacgggcctggctataaaggtgtccagcttgtatacaaaggcgaagaccggctgcttgctaaattgaagcttcctgaatccctctcccatacgaaagctgattatatccttcatccgagtatgatggacggtgcgcttcaggccgccgaatatttgcaaaacgtgacgagagcgctgctggcagaaagcggggaaccattcaaagccgcattgccgtttgctttagaggagctggacgttctgaatccgtgcgctgatgatatgtgggtgcacgtcacattcagtgcgaacaataaagccggcgatcctatccaaaaagcagatattgatttatatgacaataacggctggctttgtgtgcggatgagaggtttctcaacgcggatcatggaagaaaacgcgggtgccggcgtttcggtcagccgtacggacacattgttcgctgaaccggtctggaaagagcagacggcaccggccgatcatgcgccttcgtatgaagagcatatcattttcctttgtgagtacgatgaagccgttaaacaagctgtcgaagcaaagcttgaacatgcacgcgtcattatcctggacgatcgtcccgcatctattgcagagcggtatcattcttatgcgggtcagctgtttggccatatcaaaaccataatgaaaagcaagccgaagggccgcgttctttttcaggctgttacgcggtcagcaggcttacagcaggtgttctcaggcattaccggcctcttcaaaaccgcatgtcttgaacattccaagctgatctgtcaaatgatcgaagtcgaggagaaagaaagtgctgaaggcatcgcggaaaaagcggcggaaaaccgtatgcatgccgaaagcgtccatgtgaaatatgaaaacggcaagcgcattgccgctgattgggaagagatggatatttctcaagcggagccggacattccgtggaaagacgaaggcgtttatctcattacaggaggtgccggaggtttaggtctgatttttgcaaaagagatcgcaaaccgtacaaaagacgccgtcatcatactaaccggccggtccgctctcggagaaaagcagaaagacatgctggaaacagtacgtgctgccggcgcttctgttttctacgagcagaccgatgtcacggacgaagcagaagtataccgattgatccgcaatatccgtaaacggcacggcaagctggacgggattgttcacagtgccggcattataaaagacaactacatggtgaagaagacggcagaggaattccaacacgttctcgctccgaaagtgaagggccttgtgtatcttgatgaagcgtcacaacatgagaaattagatgtctttattgtcttctcatccttatcaggtgtgcttggaagcgtcggccaggctgattatgcgtctgcaaatgtttttatggagatgtatgccgagtaccgccgttctttacaagccgcaggacaaagatacggaaagacgctttctgtcagctggccgttatggaaagaaggcggaatgcaggcaggaaagcagacggaagatatgctgatgcagcaggcgggaatcgcaccgctcagcacagatgccggcatcaaggctttatatcaaggcttgatgagcgggacagcccggatgacggtttttgaaggagatgtgaaacacatgaaagcaaaacggttccgcaaagagaatgatcatccggaagcagagatcggcgtacgtcatgacattgatgctgacagcctgcttgaaaaagtgaagcatctgttaaaacagcagacggcctcgctgttaaaagtaaacattgacaaaattgatcctcatgaagaaatgacaaaatacgggctggattctatctcgatgactgagtttacgaaccagttaaacaaaacgtaccggcttacgttaacgccgacgattttctttgatcatccgacaatccatgaatttgccgttcatttaatcagtgaatacgaagaggaatttgccggacggtttgcggtaaatacaaaaacgattcaatcggcaagaccggtaaaagagactcaaattacgcgcccggccgttaagcgacgccgcactctgcctgagacacttccgcagacagtgcagcgggaccaagggccggaaccgatcgcaatcgtaggcatcagcgggattttcccgatggcagaagacattgaagctttctggcagaacctgaaagaaggcaaagactgcatgaccgagattccgaaagaccgctgggactggcgggactattacggggatcccgcaaaagaagccaataaaacaaacgtcaaccaaggcgggtttattgacggaattgctgaatttgatccgttgtttttcgggatttcaccgcgggaagcggagcaaatggaccctcagcagcgcctcttgctgacgtatgcgtggaaagcgattgaagatgccggatatgcgtcaaagagtctctcaggcacaaagacaggtgtgtttatcgggaccggaaacaccggctacggttctcttttagccaatgccgatgcggcgattgaagggtcatccgcggcgaatacaagtccgtctgtcggaccgaaccgtgtcagctatacgctcaatctgcacgggccgagcgagccgattgataccgcctgctcaagctcactcgttgccatacaccatgccgtttcttcaattgaagaagggacgtgcgacatggctttggcgggaggaatcaatacgattgttcttccggatgtgtatatcagctttgacaaagcgggcgcgctgagtaaagaaggaagatgcaagacgttctccgatcaggctgacggttttgcccatggtgaaggagccgggctctttttcctcaaaaagctgaaagccgctgaggcggatggggaccatatttacggcgtcattaaaggaagcgcggtgaatcacggcggccgtgcggcatctttaacaacgcctaacccgaaacaacaggcggaagttattaaagccgcatataaaaaagcgggcattgatccgaaaacagtctcttatatcgaagcgcacggcaccggaacagaattgggggatcccgttgaaattaacggcctgaaacaagcgttcagctcgtttgcagacggaaaagagaaagcggccggctattgcggcttagggtcggtcaaaacgaatatcggccatttatcccttgccgcgggagcagcgggcattattaaaattttgctgcagatgaagcatcgcacattagtcaaaagtctccactgtgagacggtaaatccgtatattcagcttgaagacagcccgttttatctggtgcgggagacgatggaatggaagacgcagacggacgaacgcggaaacgaacagccgcgccgcgcgggcatcagctcattcggcatcggaggcgtaaatgcccacgtcgtcatcgaagaatacattccagaagacagagaggaagcagatgattctcatatcgacccatgtcttttcgttctgtccgccaaaaatgaaaaacgcctgaaagagcaggcaaaacagctgaaacgtgcgcttactgaaaaacggtacgatcattccagcctcgtttctatggcatatactctccaaatcggaagggacgccatggaagaacgcctggcggttattgccggatccgcagaagaactgcaggaaaaactgtcacagtttatcactggagataagcatgcggatttgtacagaggaagaatagacaaaggcacgctgcaaatgctgacggaagatgaagaaattcaagaagccgttgaaaaatggatggcacgcggcaaatacgcgaagctgcttgaattatgggtcaaagggctgaacgtcgattgggcgaagctgtatggagaccggccgcctaaacgcatgagcctgccgtcgtatccttttgcaaaagaccgctattgggcggcgaaacacaccggaaaacacgaaaaaacaagcactgtatctgccggaaaacaagacgcgcttcatccgcttctgcacagaaatacttcaaaccttgcagaacagcggttcagctcaatctatacaggagaagaattttaccttgcggatcatgttgtaaaaggcgtgccgattttaccgggtgtggcacatcttgaaatggcgcgcgcagcaatggaacaggcatctgaagttccggccggacaaggaagcgtccagcttaagaatacggtttgggtgcggccgattaccattgaagacgagccggttcatgtcaacatccgtctcattcccgaaacggcaaatgacgttcaattcgacatttactgcggccgggaaacagatcagccgtccgtttacagccaaggggcagtatcagtccgccctgacgcaaaggctccggtcattgatctccaaaaactgagatcacaatccgccgagacaccgttttctgcagatgaagtgtacgatatgtaccgcaaaatcggttttgattacggcccggctttccggggtgtcaaagcgatttatacaggtgatgatttcgtattgggcagactgtctcttgatgcggcttgtgcggacacggtacaggagtatgtcatgcatccgggcttaatggactctgcattgcaggcatcaagcatattaaccggaacaaatgatgaacaactgatgcttccgtttgcggttcaggagcttgaagtattcagcgcatgcgctgccgagatgtgggtttacgccagactttctgaagaccacaaagccggacatgttgaaaaacgcgatcttgatatttgtgatgaaaatggcaaggtttgcgtaaggctgaaaggtttgtcattcagaacggctgaaaaagaacctgagaaaaaagaaaaagctccggaaacgctcatgcttgagccggtatggacacgaagcgatgaaactgctgctcaaacggaaccggtttttgcccggcatatcgtaatgctttgtgacacagacgccggactaaaacaagcggttgaagccgcgggagctgaatgtattgaaatgacctccctgcacgggaaagcggcggcgcgcttccgtgattatacaggacggatattggagacgctgcaaaaactgctgaaggaagagacggaaggagacgtccttatccagacggttctctctaaaacagataagcatcagctgctctcagggatttcagctctgctaaaaacagccggcctggaacataaaaaactgaaaacccagctgattgaaatagaaccagcggaaaacggcagaatcacagacatcatcagagaaaataaaacaagggctgatgacagccatatcaaatataaaaacggcatccgatacagcgcagatgtcaaagaaacggccgtgtccggcggcaaaatacgcattccgtggaacgacggagggatttatctcattaccggaggagccgggggcctcggctttattttcgcgaaagaaatcgcccggaaagtcaaagagccgacgctggttttgacaggccgttccgcattaagcgagaatcagcggatgcagctgaaatcgcttgaatcactcggagcaaaagcggaatacaaacaggctgacgtaacaaacgctctaactgcggcagacctggtcaaaacaattgaaacggaatatggcggccttcacggcatcattcatagcgcgggtgtgatgaaagatcaatatatcgtaaagaaaacaaccgaagagttttacagtgtattggctcctaaaacggacggatttgtcaaccttgatgaagcaaccgagcatttagcgctggactttttcatcgttttctcatccatttccggtgtcaccgggaatgcgggacaggcggattatgcggcggcaaacgcatttatggacagctatgcggcataccgcaacgcgctggttacggcaatgtaccgccacggtcacacattgtcaatcaattggccgctttggaaagacggcggaatgcaagtcaatgaagaaatggcgaagctcaccgaaaaaagaaccggtgtaacgccgatgcgcactgaaaccggaatagaagctctttacaaagcatggagcacggggaaaacaagcgtgctcgttatagaaggaaaccgcgccgtaatgcgggaaaaactgcttcaaaagactcccgcatccgcttttgcaccgattaagaaaacggaagaaacacctgcgccgaaagacctgacggccaaacttcaggaattgctggcaaaagaagtttccgggcttctgaaaataaacattgaagaaatcgatatcgaattggagttcaatcaatacggatttgattccattacgctgacggaattcgccaacaagctgaatgacacttatcagcttgatctgacaccgaccgtattttttgaatatgcgacgattcaagccttggcgcatcatttagcagaagactatcaaacgcaatttgccggcagcacacagccgaaagaagaaaagaaaagcggtgtaacagatgatggcggcatcagactggcagggaacaaacgatttgcaaaaacagccgtacagcatgttcagactgcggctgaacataaaccggaaccgatcgccattgtcggcatgagcggagtgtttccgaaggccgcaaatattgatgagtattggcgcaatttagaagagggaaaagattgtataacagaggtgccggcggatcgctgggactggcaggagtattacggtgacccgcttaacgaagccaacaaaacaaatgtaaagtggggcggatttattgacggagttgcggaatttgatccgctgttcttcggaatttcaccgctggaagccgaacagatggatccccagcagcgcttgttaatgatgtatgcgtggaaggcgatagaagatgcgggatattccactaaaagcctttccggcacgaaaacaggcctgtatatcggcacgggaaataccgggtacggctcactgttttccgacctggatatcggcggtgcgtcagccgcaaatatgagtccgtcagcagggccgaaccgcgtcagctatatgctcaatctgcacgggccgagtgaaccgatcgacacggcttgttccagctcgctggtcgcgattcatcacgccgtatgcgccattgaaaacgggaactgcgagatggcgatcgccggcggcgtgaataccgtcgtcacaccgcaaggccacatcgcttatgataaagcgggtgcgctgagcaaagaagggaaatgcaaaacgttctccgacagggcggacggatttgccgtcagtgaaggtgccggaattctgtttttgaaaaagctgtcagaagcggaaaaatcaggcgatcatatttacggcgtcattaaaggcagcgcggtcaaccacggcggacgtgcgaactccttgacgacaccgaatccgaaagcccaggcggaagtcgtcagaacggcttatgacaaagcgggcattgatccgagaaccgtcacttatatagaagcgcacggaaccggaacggagcttggcgatccggtcgaaatcaacggcctgaaatccgcctttcaaaagctgtacgaaaaaacaggcgatcccgccgtttacgcgagtcactgcggtttgggatcggcaaaaaccaatatcggccacctgtcactggcagccggtgtcgcgggtgtgatcaaagtgctgatgcagatgaagcataaaacacttgcaaaaagcctccacagcgaggtcatcaacccgtatatcaaactgaaagacagtccgttttacatcgtacaggaaaaaagagaatggacagcattgaaagacgaaaacggcaatcatctgccgcgccgtgcgggaatcagttctttcggcatcggcggcgtaaacgcccatgtcgtcattgaagaatatatcccgaaggaagaaagaaaaacagctgttttcacacaccctcaaatctttgtgctgtcggccaaagaagaagaacgtctgcaggaacaggcgcagcagctggcgcaagcttcttttacggatgcggatcttgccgatgttgcttacacgcttcagcaggggcgtgatgcgatggaagaaagagcggccattatcgcttcctcggccgaagaactgcgggacaagctaaagagctgtgcgaaaggacgttatgacaaagcgggcatttataaaggaaaagcgggtaaaatcccgctgaaatccattatggcaggcgcaaacggcgaagcggatatcgaagagctgataagccgccgggagaatgacaagcttgcggaattatgggtgcagggcgcggatatcaaatgggacggcttatattctgatatcaagccccaacggatgagtcttcctgcttacccgtttgcgaaagagcggtactggatcacggacaaccggccgaaagcagaaaaaccgcaagctgtgccgacggcgcgggtgctgcacccgctgctacacgagaatgtatcggatttaacagagcagcggtaccgatccgaatttacgggacaagagacgattttcaccgatcatcttattaaaggcaagccggtcatgccgggcgtcgcctacttggaaatggccagggcggcggttgctcaggcagtcaaagggcaaaaggaagttccgtctgtcatccgtctgaaaaacatcgtttgggttcggccgatcgaagcggaaaaccgcccgattgaagcgcaaatcagcctgaacccgaggggaaacggtgaaatcgtgtatgacatttacacggattcacaaacagaagcaagcggcaggcagatacactgtcagggggctgccggcattctcggcgccggggaggctccgcaccgtgatataggcgcactgaaagctcaatgcggcctcagcatgctgacttctgaacagtgttacggcttattcaacaaaatcggcattgactacggtcccggacaacaaggaattcagcacattcatatcggaagcaatcaagcattagctgagctccgtctgccttccttcctcgaagaaacagcagatcaatacgttcttcacccgtgtatgcttgattcagctctgcaagcgacaatcggactgaagctgcatgcagatgataaccagctgtcactgccgttcgcccttgaggaactggacattttcagcccgtgcacgaccagcatgtgggcgtatgtcagctcccggggaacggatgaaaaaatacagcggctggacattgacttatgcgatgagacaggccgcgtctgtgtcaggattaaagggatttcttccagaatgatggaaggaccggcgccggaaacatcattaaatggagcaaaccttctggctccggtatgggatcttgcggaattccgtgaccaaagcccggcatataagacggaagaggttgtctttatcgcaggggatgaggaaagcgaggcttttcaattgcatcatccttctgcgaaacggcttcatatcaacccggaggatgaaatagaggctgttgcggctgaactgaaagcaagagggtctttcgggcatatcgtatggatcgctccttttcacagcgatggtgacatggtgaaagctcaagatgcgggcgtcatccagatgtacagagtgattaaagcgatgcttgctttaggatacggaagcaagcgaatcagcttgactgcagtcacaataaaaacacagtccgtacagccggcggacatcattgatccggctcatgcaggcattcacggtttgatcggttcgctcgcaaaagagtatccgaactggcaaacacggctgattgatgccggatgtccggaagatgtttcaaaggcggagctgttctcagcgccgtttgatgagcaaggcaatacatgggcgtaccgcaacaatcactggtacaaacagcgcctcatccctgtacagcagccggtgtcaagccggcccgcttaccaaaaaggcggcgtttatgtcgtcattggcggcgcggggggcatcggcgaagcatggagcgaatatgccgtgaaaacgtatcaggcgcgagtcgtttggatcggcagacgaaaacataacagcgccatccaggaaaaaatcgacagactcagccaattcgggccggcgccgatttatattgaagctgacgcggcaaacccggatgagctcacacgggcgtatgaaacgatcaaacgcacgcacccgcaaattaacggaatcatccattccgcaattgttttagaggatcagagcctggcgaatatgccggaaagccgtttgagaagcgtgctcgctgcaaaagtcaatgtcagcgtgaatatggccctcgtgttccaaaatgagccgctggactttgctttgttcttctcatccgttcaatcatttgcgcgagcggccggacaaagcaattatgctgccgggtgcagtttcaaagatgcctttgccgctcatttggctcaagttcggccgtattcggcggcagtgatgaattggagctactggggcagtgtcggaatcgtatcatctgccgaatatcaagaacggatgaaacaggcgggagtcggatcaattgaagcgccggaagcaatggcggcgcttgaacgattgctcggcggcccattgaatcagttcgtcatgatgaaacaggcggaagagccggaggaaaaaccggaagaaatgatagaagtataccctgaacatcacggctcggcgatgcaaaaactgcgaagctatcagcctaaagtaacaagacatgtacaacaattgagttaaggaggggacggctttgcaaaacactgaagatcttctttacaaactattggcaggccagctgaaatctgtcggattttttacggaaaacgaaacgcagcctgttatgcaggggttttacggcaggtggctggaagaaagcatctccatcttggtgcaaaaaggctttttgaaacagtctggcagtacgtatgtgttaacgggtccgatagagcgtgcggacgttctgtggcaagaatgggatgaaaagaaagctcctttactcaaggacagcagcaaacgggcgatgatcaccttagtggagaccgctctcagagctttgccggatattttatccggcagagtttctgccactgatgttctgtttcctgattcctcaatggaattggttgaaggaatctataaaaacaatgaaacggcagactactttaatgaggtgctcgctgacacattgacggctttcattgaagaacgcctgaaagaagacccgaacgcggaaatccggatattagagatcggagcggggacgggcgggacgagcgcggccgttttcaaaagattaaaagaggtcaaacatcatgtgaaagaatattgctacaccgatctgtcaaaggcctttttcatgcatgctgaaaaagaatacggtcccgacaatccgtatttgacttataagcggtttaatgtggaagagcccccggctttgcagggtatagaggcgggtgcatatgacgcggtaattgcggcaaatgtgcttcacgcgacaaaaaatattcggcggacacttcgcaatgccaaagcggtgcttaaaaagaatgggattttgctattaaatgagatcagcagccattcggtttattctcatctgacattcggtcttttggaaggctggtggctgtatgaagacgccaaactgcgtattcccggatgccctgggctgtatcctgaagcgtggcagtctgcgctggaaagcgagggatatcggtacgttacatttatggcggaatcgtcacatcacctcggccagcagatcgtggcagcagaaagcgacggcgtcatcaggcaaaagcagccggacgcgccggcggttgaagaaattgcggcttccaaagagccggctgatttcacagaaccgtctttctcagtcacagaccggacggtgcaattcataaaagaaacgttagccaagtccataaagcttgctcccgagcgcattcagccggaaaccagctttgaaaaatacggcatcgactccattttgcaggtgaattttatccgtgaactggaaacattgacgggcgagctgccgaaaacggtcttatttgaacacacgaatacgaaagaacttgccgagtatttgctggaaacttacccggataagctgcaacaggcattcggagccgatcaagcgcctcctgaaacggagcatccggaacctgcaatgaatgaaccggtgccgcttgtcacggaaacgcggcgatttatcactgaacaaaaagagccaaaagcgccaaagccggaaacagaaaccgtcaccgataatcgctcagatcgtgacgacattgccattatcggcatcagcggccgctatcccgagtctgaaaccctcgatgagctgtgggagcatttaaaagccggagacagctgtattacggaagctccggaaaacagatggaagtccggtcttctgaaaacgatggcaaaagaaacacgaaaagaagaacgcaaaacacggtacggcggatttctgcagcatattgacgcttttgaccatcacttgtttgacatccgggaagaccatgtgatggagatgacacctgagctccgtctaagccttgaaaccgtatgggaaacatttgaaaacggcggctactcgttagagagagtaaacgaatggcaggaatcagacagcggaatcggtgtatttatgggcagtatgtacaatcaatatttctggaatatcccgtcattggaaaaagctgcgctcagctctaacggaggggattggcatatcgccaaccgcatttcccactttttcaatttaacgggcccgagcatgggcgttacgaccgcatgctccagctcactgagcgccattcatctcgcctgtgaaagcctgaagcttaacagctgttccatggcgattgccggggggtcaatctcacgcttgaaccgtctaaatatgatgcgctcgaacgggcgaatttgcttgaacagggaagtgaaagcaaaagcttcggaaccggcacggggctgatgccgggagaaggagtcggtgcggtgctcttgaagccgctctccaaagcggttgccgacaaagaccatatttacggggtcattaaaagcagcgcgttgtgccatagcggcggaaggcagatgtacacggctccggatccgaaacagcaggcgaagctcatggcggcttccattgacaaagccggaatcaatccggaaacaatcagttatgttgaatcagcggcaaacggctctgtattgggagatccgattgaggtcattgccctgacgaacgcgttctcgcaatataccgataaaaaacgattttgcgcgcttggatccgtcaagtcaaatctcggccatttagaggcggcctccgggatgtcccagctcgcgaaagtgctgctgcaaatggagcgggaaacattagttccgaccattaacgcaaaaccgcaaaatccgaatatcgcgcttgaacaaacggccttttacctgcaggagaaaaccgagtattgggagcgtctgaaggatgccgagacgggagacatcgtaccgcggagaagcatgatcaattccttcggggcaggcggggcatatgcaaatctcatcgtagaagaatatatcagcccgaattccgatcaggcccgtcacggcgatgaggaatatattttccctgtgtcagcgaaaacaaaatggagttttgaagcctatcttgagagactggcggcctttttagaaaagacgccatctcttcatccggccgccatcgcatctgcgctgcaaaaaagaacgcatcatccggagtatcgggcggcatttacggctgcttccgttcaggaactgctggaaaaactggccgcttaccgcatggatcagcggaatctcaatttctccgattctgatatcggccggcgtgcgcggcaatgggaaaaaggagagaatatcacgtttgatcagttgcagcaagagcacgccgttcatctgccggcctacgcttttgaccacgggacttcttttcatttcggtgaatcagaaaacgctgccggcgttcaggcggtatacagtgatgacgacccatacgtgaaagggcatcaattcggcggagaaccggtactcgtcggcgctacatataacagtctggcagtcgatcatttttgtgacctttttcctgaagcggaaggaggacatattaaaaaactgaattacgtcagccccattaccgtaaaaaaaggcgatcacatcgagctgaaaacagaatcgaaacaaaacggggatggatttgaactgagcataatgcaccgcagccgcacgtctcctgattggagcatagcggcgtatgccgagtgcagcccgtatccgtttcaaaagcagcacgcagatctggcggccattcagcgctcttaccgggaagtgggccggatagatgagttatacggagatggaacgggaaccgtcgtgtggggagaagaatttaaaacgatcacccgtctgtacaaaggcactgatgccgttttagcgaaagtgaacctgaacaatagcgactcacaacaagcgcatcattatgccataaatccattaatcgccaacagtgcttacttggcctcgctttctttattggaccaaacagagacggaaagctatctgccgttcggcattaattccgtcaccttcagcagcccggaaaatcttaccgattgctggctgcacatcaagctggctaaacaaacgggggaaatgattctgattaacgcagatgtcatcagcagccgatcggaagtggtgatgcgttttgaaggctatgccctgaaacggttccgcccgaaaaccgaacagatgaatcagccggcccgaacggctgttaagaatgcgggagcaccgatttctgccggcagtctgacagatgatatccgcagctacgtccttggcaagctcgccaagatgatggatgaacccgcgtcatctcttcgttctgacgcgaatatcatggaattgggacttgattcagcgagtctgatcgggctgacaaaagagatcggccaagaggcggacatcgatgtgaatccaacattgtttttcgagtatccgacggcggaggagctgacccgccacttcgcgtcagcatatgagagcaagttttctcaattgcttgccgatcataggcattcagaagaggccggggtcacggaaacagaagagcgcactttaccgaagaaacagcatacgccttgtgaaaacgccgatgtcaagcaaggaatcgcgattatcggtatgtcagctcagtttccgcaatccccggatatccagtctttttggggacacatcgtaaacggggatcactgtattaccgaaattccggcggaccgctgggactggcgccgttacgccggcgatgagaatgacacgagtctcagatggggcggttttattgacggtgtcggcgaatttgacccgctctttttcggaatttctcctaaagaggcatcacaaatggggccggagcagtttctgcttttgatgcatacatggaaggcaatggaggatgcgggcctgacaaataaggcattatcaagcagaccgacaggcgttttcgttgccgcgggcaacagcgatccgaacaatggaacagccattccgtccatcattccgaacaggatatcatatgccttgaatttacaaggaccgagtgaatattacgaggctgcctgcacgtcaacgctggtggcattgcacagggcggttcaatcaatccatcataacgaatgtgagcaggctgtcgtgggcgccgccaatattctgcaatcgccgaaaggttttatcggttttgactcgatgggatatttaagcaaaaacggccgggcgaaatcgttccaaaaagatgccgatggctttgtcagaagcgaaggggcgggcgttatcatcatcaaaccgcttgaggcggcaattgaagacggcgatcatattcacatggtcattaaaggaacaggagtgtctcacggcggtaaaggcatgtcgcttcacgcaccgaatccggcgggaatgaaggccgcgatgaaaaaagcgtacgaagacaccgatgttgatccgcaaaccgtcacttatattgaagcgcacggcattgcctccgaaatggcagatgcgctggagtttaatgcaatcaaagcgggttacggcgagtctgcaaatcaagaggaaagcgcgccttgttatatcagcaccgtgaaaccttgcatcgggcacggcgaactcgcttccggactggccgcccttataaaagtagcgatggccatgaagcatcataccatcccgggcattcccggatttacagctgcaaatgagcaaatggttattcagaaaagccgcttccgtttcaccgaagacaatcaggaatggtcacagctcaccgaccatacgggcagaccgatcccgcgccgggccgcaattaacagctatggcttcggcggcatgaatgcgcatgtcgtcttggaacagtacagtccgagccataaagacaaagaatctgcgcatgacccgcagcttatcgtgctttctgctaagagcgaagggcgtcttaaggcggccgcaggtcagctggctgattttgtgcaaactggagatactccgtcactgcgggatattgcttatacgcttcagaccggccgtgaggcgatgaactgccgcttggcactcgttgcccgcaatcaagatgaattgctggaaaaactgaaagagtacagagcattttccgaagaaagcaatggaatgaaaagcttctttacaggcagtcagcagactggatcaggagatatcggcgttttactggaagggactctcggtacagtcgtcacggagacgctgttggctgaaaacaatctggaaaagcttgcattttgctgggtgaaaggagcggatataccgtgggacagactccaccaaggcaaatctgttcaaagagtgccgcttccgacatatccttttgaacaccacaagtattggaatggcggtcagccagaagacatcacccttgcgccggtttcccaggaccctcagctccgccgcgagagcgcagctgacattgtggctgacattttggggatgaaggcagcggaaattgatcaaaataagccgctgactgaatacggctttgattcaatctcctctattcagctgctgaaaaaacttgaggacggagacagccgcatcagtctggaagctcttcagaaatgcagcactcttcaggagatcggcatgctgttaaaaacgaaccagccgcatgaagcgggccggaattttcccgaactcgtcaagctgaatgaaagagaaaaaggccgtcctgttttttggtttcacggcggaacaggaggcgttgaagcataccagccattcgccaaaaagagtcagcgtcctttttacggcatccaggcaagaggtttgacagggaaagagccgctgcaaggaatcgaagagacggccgcttcttatatgagaatcatccaagcggtacagccgaaaggcccttatgacctcggcggatattccttgggcgggatgcttgcttatgaaaccgcgcgcctcttgcaggaggaaggtcatacagtaaaaagcgccgtcatgatcgacaccccgtacagtgaaaaatggaaagagagaaaaccatctgttaagtcagtcatgctgcaaacgatcaatacgatgcttacggcatatcttaagcctgaaaaccttgaagaggcattaatcagcagagaagacattaccgtccaggctgaggaagaagaagtattgaaagaattgatcggccttgccaaaaagcgcggtctgccaaaatccgaagaagcgatccggatgcagctggagcaaatgatgaagacgcagctcgcttacggaatggaagagtatgacatgaagccgctgcctcatccggaagcgctgcaatgctactacttccgtaataaaagcggtttgtttctcggagattttgaacgttatctgacagcagaggaagaacaaattccgttagaccatgatgcgtattggaaagaatgggaacaccagatgaaacactttcacctgctggacgtccactcttccaatcatgtcacaatgctgtcggaaccaaagccgcaaaacgccattaaggcattctgcgaaaaactgtacgcaaacaaaggaacgataagcgcaaatttccttaaatctttcaaaaaaaagctggacgaaacaaatgagttggtaaaacggtaatagagaacggccggagcaatccggccgctttttttacaatagaactaaatacactatgtactaaatattcactgttatattgatttcctgtttataagacattaaaaaacccccgataaacagggggcgatattaaaatctgacaggcaatgtttcaagccctctcaaaaacacgttttttctccactttacatcctcgtgcgcgcctttcagctctatattcggaaaccgttttaaaagcgaagtaaaggcaatggatgcttccatccgggcgagcggagccccgagacaaaaatgaatgccgaatccaaaagagatatgacggttcggtgttctcgctatatttaatgtatcaggatcatcgaaatattccgggtcccgattggctgaaccgatgccgataaatatcatatcgccttttttaatagaaacatctttataggtgaaatcttcaatcgcccatcgattcgccatcatgatgacgggagaggtgtaacgcaaaagctcttcgaccgccgtctggatattttcgggctgtcgctttatcttctccatctggtctttgtgcagaagaagcgccagggtgccggagccgagaaggttaaccgttgtttcaagcccggcaacgactaacaaaaacagcatggaatacagctctgattcactcagcttttggccgtcctcttcagcgtaaataagcttgcttgtcagatcttcagcgggatgttttcttttttcttcgatcagtgttttcatatattgtttaaattctttgagagcctggttggtcgcatcttgtccgctctctgacgtgtcgaccatcgcgtttgtccatacttgaaatttggcgcggtcctctttcggaattccgagcagctcggaaatgacgataaacggaagcggtgccgcgaaatctttcatgatatcagggtctgcttttgtttccatttcatccagcagctcttctgtgatctgctctatcccggtgcgaagctgctcaatcatccggggagtgaacccctgatgcaccaaagatcgaagacgtgaatgatccggagggtcttttgccagcatatgctctgagacaaaatcgatatcttcgctgacattcagcttcgcgatcagctccttcggcataacccgttttacatctctcgtaattctgccgtcttttaaaaacgccatacaatcatcataacgcgtgatgagccatgccggaaaggtgcctccgaaacgctgcagttcgaatttatgtatggggtcctgctctctgaatctgcttaaaaccgcaaaagggtcttcgtgaaactcgggtgagtgtgggtgaaacattgttttttccatctggatttccccgccttcatgtttttgaaaagacataaccaacagccggtgcctgccgaccggacggcattcctccttttatctgccgaagacactgatcacaacggctcataagtatgtctaaaatatataaggaaaaagaagccggttcaatagacaaatcgtaaagccgccattttcgttgattatcaacaaaacagcaaactttttttgccatttcatcatgtgtgttaaatccggctaatatacatatttacgcttcatatcaacttcttaaggaggatgtgaatgaatgcgtttatgaaatgggcggcaagtctgcttttggtgatctctcttcagttcggccttacgggcgccggcatccattcggacagtgctgctcatgctgcatcccgatacgatcaggtgctgtatttcccgctgtcaaaatatccggagacgggaaatcatataaaagacgccatttcggcaggtcattctgagatttgtacaattgatcggggcggagcggagaacagaaggaaagaatcattgaaaggaattccgacaaagcccgggtttgaccgtgatgaatggcccatggcagtctgcacagaaggcggggcgggggctgatatcagatatgtaaccccatcggataaccgcggggccggttcatgggttggaaatcaaatgagcggctattccgacggcacgagagtattatttatcgttcagtaacttctccggttcgccggagtttttttatgctttgaaaaagcggcacgccggctggacatatgaaatggcaaagagtaaacttatatgttggaatcagcatgagaaaggattggatcacattgacagtgactacataccgaaatattgcacttttacttctttgtttaacagcgggaattgtggatgtgatcggttatttaagcctgggacatatctttaccgccaatatgacggggaacatcgttctgttcggcctggcgatcggcaactcatggcaccttgccgtactcaaatcgttaacctcgttaatcggatttattgccggcgttattgccgcggccctgcttgtgggcaataaaaagaaatcattctggccccctgcggtaactgccgctttagctattgaaggagctgttttgctgctgtttgctttgttctcctgcttttttgcagacgccatttctgtttatgtgctgattatgctgctcagcttcgcaatgggaatgcagacgacagccgcgagaaaacttggtgtagcggggatttccacgaccgtattaacgggaacgctcgctaatttttttgaagatctcaccgcaaggttttacaaagcggacaagcggaagcagtttacgagagatgctgtattgcgcgcgcttgccttggttctgtattgctttggggcggtcataggcgcttttgccgaaccggattataagtttgccgtgatctggctcccgattatcattattttaggcattatgctttgcgcattcacgatgttccacggatattctgaagaaaaaaaccaataaaaaacgccgctgtttcacggcgttttttctttttattgctctttccgggtcccgattgtatacacggcccgatctgtatgtacctttaatccgtcttgctcctgttggatggtaatgtcgccgagcagaggaatttcatacgcatcttggggaagcgggacatttccttcctccgtataggttgtgccgtgcccttttaagacgagttcttcatccgctacatagtcatcgggatggtttgtccggcggacgagaacgtcatcaaggtgaagcatgatctgatccatatcagaaatctcgtttcggctgtctgtcagctctccttttctgatatcaagcgtttgtccgatctgtttttgcagccattcagacaattcggtgtttgtaagtgccattgtgattcctccttttatctacaccatacttattccctatttttttagaaatacactgccttgcgttgatctttttttctgacagccggttctgacctgttccgagttccttcattataaatgtttcatctattcacctgaaaaacggagtcatctgccggtgcagacgaccccgttctcatgataaaaaggttactctttcggcacggcgttttcggcgttcactgcgcccgctccgtaaatgttcggatcttcatttgtccattgatccggactttgtctgatcaatgttttcacttcgtcaggcgaaagctgcgggttttgctgaaggattaaggcagcgatgcccgcacagatcggagtggccatggacgtgcccgacagactgaaatacaaggagcctactcggtttgatttctgtaatttgtcaagatatgaacgcggagaacgaagagatacgatatcgaccccgggcgcaagaatgtcaggcttctcttttccgtacaccgtcgggccgcggcttgagaaagaagcgaccgtatcgtcctcattgctggctgtatcattgtcatcataggcgcctaccgtgatgaccttctcgctgacaccggggcttgaaatcgtttgagcttccggaccggagttgcccgcggcgacgcagacgacgattccttcattccatgcctcttcaacggccttgacgagcgggtcgtccgtttctttatcatatttgagcgcatctccgcccagcgacatgctgatgattctgatcggattctttgtgtgttctttattatattgtatgcaccattccacaccttcaatgatatcagccaaggttcctgatcctgatttgtttaaaaccttgactccgatcagatcggcttccggcgccggcccctgatatttacccgaagatgaagcgccgctgcttgcgatatcaccggcgcaatgggtgccgtgtccgttgtcatcatacggttctgtcttttggttgacaaagtccgcaaagccgataatcctgccttctaaatcaggatgctgatagattccggtatcaataacggcgacggttacgccttttcctgttaatacggtgccgttacgggtcacttcttttgcatgagacgattcagctgctgtatcaaggagagcttttacttcacggtttaaatagattttacggatatcccggcattgcgaaagaagcatgtgaagggcggacggcgtgacttcggcgctgcagcaattgattgtttgaaactgcttttttatggtgcagcgtttttcttttgataagacctgtcctgtgctgtgaaaaccggattcatggcagccctcttcaaattcaatgatgactgacattttctttctgtttttcacctttttttcgaaaaaattgtgtaaaaagcaaggtgtccatttgaaaggtttatataactgtaatacgttttctctgagcggccagtccagcttatgagcatttgaccgcaccatttgtaccattgagtaaccaaacatatatacttttcctcccattctggcgattctctctataccatatgaacaggccgtaagttcggtcagtttgtttgtccttcaggagcgctggttacttgcggctttttcaggagaagaaatcgagttgaaacggaacgtttgttcgttttgtaatgaagccggcggaaggtagtatatacatgaacatcatattgagacattccttggaaaaacagcttccgattgatattatatatatgaataaagagacggctccgtttcaaaacggaccattatgataaaaaaaggggatgagcgggctgtaatggcattttgctgtacaaaaaggcagatgagaacttttttgacgggctccattctgtcctgcgcatttgcttcgggaggcggatattcatttctaaaagcgtattcttgatgccgtccgtttccggccgtgaatctcccgcccctgaaaattcgggcgttcctccctttttttttgccctctctcaaccttttttcactgatgcccggcatttgagcgcttgaaccgtgacaatccattgatttttcgaaaccgggaagtttttcactgatgataatgttaatagaatgttaagataagacctattgacaaaaatccatataatgaatatttcatttttcagaaaggagcaaagaaggagagctgatgaaaagaattttacttaatgtcatcattatcgtagcaatggtcttactaataagatgtgctcattatgcgtcagaccctgatccctcgaattcttctgatacatacacagattttaaagatctggctgaacatgaagaccccgatgattatcatatatcgtacaataagagaaaggggagccccgtattgatcatgtccccgcacggagggagaattgagggcggggtgagcgagatcgtccgctctttcagggatgattattcaacctacctgtttgagggattaaaagcgcatgataaccagactcttcatattacgagcaccaagttcgatgagccttcagcagtcgaaagcattaagcagcaccattatgttatcgcagttcacggttataaaggcgacgagaaaaatactcttgtcggaggaagcgaccggaagcgggcgaaaaaattggtgagagctctcaaacgaaacggatttcctacagaattggcaacctcaaaaaccggtctggccggggttgacaccgaaaatatcaataaccaggcgcaaaccgggctgagtatacagcttgagatcagcagagaacagcgggaggcgttttttgataattttgattaccgcgaaagggaattcacaaaaacggaggaattttaccggtttgtccgtacgataaaaagagtgatcaatcaagagtattcgtgagcttaaaaaaagacaaaccagtgaaaggtgagtaaactgaaaaaaaaggaggtttgtcccttggcaaaacatcacttttatttaaaagcaaattggcccggaaatcgcaatgacgtcggcgatattaaaagcggccggctggaaaccgctgtgtccattcctaaggaaatggacggacccggagaaggcacaaatcctgatgaaatgctgcttggagcggccgcgacctgttatattataacgcttgcggcgatgatggaaagaagcggcctggataaagaagatctacatatggaatctgaaggaattgtagacgtcacgaacggtgtgttcacgtaccagaaaatcattcaccgcccgtttatattattaaagccggatgcagccgaaacggactttacgctcgccaggaagttagcgcaaaaagcggagtcctcatgtatgatttcacgagcggtccaaggaaacgtggagatggagcttgaggttgaagtaaaagctgcccgcgcttgacgagttcaaacggtcagctccgggccgtttgattttttttagctttttgagacttggaacggttcagcaggatgacgcccgtgatgacaaaaataagcccgatcatcattttagctgtcatggcttccttaaaaacaaaaaagccgacaattgccgttaaagccgtgccgacacctgaccatgtcgcgtatgcggcggataaatcaaggcttttcaaagagaagctcaaaaacataaaagaggctccgattccggcaatgacgccgagagcgggccataagtgcgtaaaaccgtccgacagcttcagcatcgtgcttccgaacacttctgatacaatggctaatgccaggcagagtaatcctttcatatcatgcttctcctttctaccaattcatcagaatgacaccggccaataagaatacaagtccgatgacggcctgcttgtccagtttttcatgaaaccatttcgctccgataatggatgcgagcaccgttcccgctccgctccatgttgcataggataagctgagcggaatgagattcagtgtaagtgaaagcatataaaaggccaatgaatagcctgccactacaagcgcgctcggcaaaaaccgcgtaaatccgcgggagaccttcagcatggccgcgccgattgactctgataaaatagcaattgtgaggaagatataacccagaatcatatcaaatccccctctcatcataatccttatgccttttgtttaaggcagtaaaataaaataatatccgaactttgcccgccaagtcaagacattaggcctatataaaaaggcccctgaaaggagccctttttgattgtcttagtagtaatacggatagtaagggtagccgtaacctccgtacaggtacggattgaataaagcgcttccgacaagcccccgacaagccctccgaagaacggtccgccgtaaaaaccaaacggccgtccgaatccataaccaaaccaaggccggccaaatccaaaacccggccgcccgaagccgaagccgaatccgggccgcccgaacccgaagcccggccgtccaaacccaaatccgggccgtccaaacggtctcatatcactatctgctgcatatgtgtattcttcattcataatttaggtacctccaagaataaatttgagatgataacagagtattcagcccaccaatttttgattgggcatttatcaaaaaaataaaggagtgagcttttgtgggcctgtatcagtccgattggtcaaaaaaacctccgcacacacacgcataccgggctgttacggatgtagtgcaggggcactaccatatgatcgaaggcttttcgcagccggagaacggcagcaatacagatgagcatacacatttctatacgggcatcacctcgtttgaaaacggccattttcataggtattacggcatttccggccctgccatcccgagggttgacggaacacattaccatgagctttcagagaccacctttgccgcctacaatgagccgattcggatccagcatggcggcgtcgtttacgatccgcgggaggaaggacggaaaacgcaccgccatacgctcaaaggaaaaacgagagaggttgtcggaaacgagccgatcgggtggtagcggacgtttagcgctcaggaaaaagggcaaaatggataggtgcctgaagaaatgaatgctataattagggggagatttataaaagagagtgatacatattgaaaaataaaaaacagcctgtcgtcatactcgtcggaccgacggcagtcggaaaaacaaaactaagcatcggactcgcgaaaatgctgaatgcggaaatcatcagcggagattccatgcaggtatataaagggatggacatcggaacggccaaagtcaccgaagaagagacagaaggcgtgccgcatcacctgattgatattttggagccgtccgacactttttcaacggcggattatcagaaaatggtgaggggaaaaatcaccgagattgccggtagaggaaagctgccgatgattgtcggggggacgggtctgtacattcagtccgtgctgtatgactatacgttcacggaaaactccggcgaccctgtattccgggagcgaatggagaaactggcggctgaagaaggggcggaagcgcttcatgccaagcttgcggcagccgacccggaagcggcggcagccattcatcaaaacaatacgcgaagagtcatccgcgcgctcgaaatcctgcatgtatcgggaaaaacaatgtcagagcatcttaaaacccaaaaacgggagctgctttacaatgcggttcttatcggtcttacaatggacagagaagtactgtacggccggattaacgagcgcgttgacctgatgctggaaaccggccttcttgacgaagtaaagcggctgtatgatatgaatatccgggacagccaatcgattcaggcgatcggctataaagagctgtatgaatatcttgatggaaaagtgccgcttcctcaggccgtggagcaattaaaacaaaattcaaggcgatatgcgaaacgccagctgacctggtttcgcaataaaatgcccgtttcatggacagatatgacgccgcctgttgatattgagcagaaaaaaaaggaaattttcgagtgcatagcaggaaaactggaaatttaatcgaaacagtattgtattgagaaccaaggaggacgaaacatgaaaccgattaatattcaagatcagtttttgaatcaaatccgaaaagacaatacgttcgtcacggtgtttttactcaacggctttcagcttcgcggccaggtaaaaggctttgacaactttaccgttttgctcgaaacggaggggaagcagcagcttatttataaacatgccatctccacgttcgccccgcaaaaaaacgtccagcttgagcttgaatagactttttgacaaagaccatgaacaatggtctttttctatgcgcgtctgtatattgcaggccgtatatcggaaagataaaagggggttcggaaaatcgtgttcgaaagtgaaaatgaactgagaagaatcaggattacgctcgtttggatcgctgtttttttgctgtttggagcttgcagcaatcacgagacggtggtgacggatgatgacggcggcttggcggatgccgaatcgcagacagaaggcatggtgcagctggaacataatcgtttcggcattgtcgagggcggttatctaaaaatataccgctatgatgaaaaaacgaataaaatcgaactgaaaaaagaaacggcgctggatgagcttgaataaatttcacaagcgttcgaatttacaaagcgggccgcacaagctacactaagtactgacattgatcatgcagagggtgagacgattgaaacacaaggtgataatcaaccattgggaagaaacttgtgaagatgattcctgctatgaatatggaaccagcatcatcgttgacggcaaagaactgatcagggaggcttccatcacaagcgctctgaaagccgtactgaaagaaatcggtgctgatgtagagattgaagaaaccgttgaaagcgaaaaaaaatgtgattcttacaaaaaataagaataaaagtctagactactaagcagttttttttcatgttatgatagacatcggcttacacatgacaccttgagtaggatgagagatgattctcgttctgctctcttttttgggcgttaatcgggccggagccaaagtccgctctttcaaaaatatgaattttttataaatcgatctcaatatgttgtgtttttctgagaggttagtatactatatatagtgttaagagattcattatttttgataggtcgtgataaggatggttcaaatcatatttgattcaaagacagggaatgttcagcgttttgtgaataaaacagactttcagctgatccgcaaggtggacgaaatggaccacgtggacactccgtttgttttggtcacctacacgacaaacttcggtcaggtaccggcatcaacacaatcatttctcgaaaaatacgcccatctcttattaggagtcgctgcgagcggcaacaaagtatggggcgataactttgcaaaaagcgccgataccatctctagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaacaagatggaaaattccagtttgataaagataaagaggctgtacatagctattttgtagactatatcaatcaaaacacagttttctttcacgatttaaaagagaagctggattatttgattgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgcaaatggcgacactgagaaagcaaaagaatatgtgaatctgatgatcaatcaggaatatcagccgagcacaccgacatttttgaatgccggcagaaaacgccgcggagaactggtgagctgtttcttgctcgaagtcaatgattccttaaacgatatttcacgggcgatcgatatttccatgcagctttctaaactgggcggcggtgtttctcttaacctgtccaagctccgcgcgaaaggtgaagcgattaaagatgttgaaaacgccacaaaaggtgttgtaggcgtcatgaagcttcttgataacgcgttccgttacgctgaccaaatgggccaaagacaaggctctggcgcggcgtacttaaacattttccaccgcgatatcaatgactttcttgatacgaaaaagatttctgcggatgaagatgtgcgcgtcaaaacgctttctatcggtgtcgtcattccggataagttcgttgagcttgcacgtgaggacaaagcggcttatgtattctatccgcacacgatttataaagaatacggccagcatatggatgagatggacatgacggcgatgtatgaggagcttgttgacaacccgcgtgtcaaaaaagaaaaagtgaatgcgcgcaaattgcttgaaaagcttgccgttctccgttctgagtcaggttatccgtacattatgttccaggacaacgtaaacaaagagcatgcgaataaccacgtatcaaaagtgaaattctcgaacctttgctctgaagtgcttcaggcgtcacaggtttcggcttacacagattatgacgaggaagacgaaatcggcctggacatttcctgcaaccttggttcattaaatattttgaatgtcatgaaacataaatcgattgagcgcacggtgaaactcgcgacggattccctgactcatgtatctgagacgacggatatccgcaacgcgccggcagtcagacgcgcgaacaaagcgatgaagtcgatcggtttaggcgccatgaaccttcacggctacctggcccaaaacggcatcgcttatgaaagcccggaagcaagagattttgcgaatacgttctttatgatggtgaacttttattccatccagcgttcagctgagcttgcgaaagaaaaaggcgaaacgtttgagcattacgaaggctccacttatgcaacgggagaatatttcaataaatacatcgaaaaagagttctcaccggcatacgaaaaaatcgctgcgctctttgaaggcatgcacatcccgacaatcgaagactggaaagagctgaaggcgtttgtcgccgaaaacggcatgtaccacagctacagactgtgcatcgcgccgacaggctccatttcctacgtccaatccagcacggcgtccgttatgccgatcatggaacggatcgaagaaagaacatacggaaattcaaaaacgtattacccgatgccggggttagcgtctaataactggttcttctacaaagaagcttatgatatggacatgttcaaagtggtggatatgatcgcgacaatccagcagcatatcgatcagggaatcagctttaccctgtttttgaaagatacgatgacaactcgtgatctgaaccgtattgatctgtatgcccaccatagaggcatcaaaaccatttactatgcaagaacgaaagataccgggcaggacagctgtctttcttgtgtcgtttgattaaaggagagttaacagtgacaaaaatttatgacgcagcaaactggtcaaagcatgaagatgatttcacccaaatgttctacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacaggcatgccgattgtggccgagcacgtcgaaggccatcagcgaaaagcggttcttaatttcatggcgatgatggaaaacgcggtgcacgcaaaatcatattcaaatatttttatgacgcttgctccgactgaaacgatcaacgaagtatttgaatgggtaaagcagaataaatatctgcagaaaaaagcgcaaatgattgtcgggctttacaaagccattcaaaaagatgatgaaatttcactgttcaaagcgatggttgcttctgtctatctggaaagcttccttttttacagcggtttctattatccgttatatttttacggacagggaaaactgatgcaaagcggtgagatcatcaacctgattcttcgtgatgaagcgatccacggtgtatatgtcggactgctggcccaggaaatattcaataaacaaacagaagcgaaaaaagcggaacttcgcgaatttgcggttgagcttttagaagagctttatcacaatgagcttgaatatacagaggatctctacgaccaagtcgggctgtctcatgacgtaaagaaattcatccgctataacgccaataaagctttgatgaacttagggttcgatccttactttgaagaagaggatattaatccgattgtattaaacggattaaacaccaaaacaaaatcacatgatttcttctccatgaaagggaacggctacaaaaaggcgacggtagaaccgattaaggacgaagatttttattttggccaagatgaagagcagatataatatctgctcttttggcttgagtggagaggtaagacaggaggaacgggcatgaataaaatggatgaaatcatcttggctgcaccgcggagtgacgtctttcaaaacgaaatgctgacatttcagggagtcaacagcgaggatgaacgtatcataaaaattatggctcaaattgaggcgcatttttttgaaatcagaagaggcgacgcggaagaggacccgcgatttaaacagccgattccgtatgtcgtcatccgccgcgatgatgaggtatttgtgtatgaacggctcgcgggcggaggggaatcgcgcctccataataagctttctctcggcttcggcggacacatgaaccctatggaaggggcggcttcatttttggaagtgctgaaacagaacaccgaccgggagctggcggaagaattgtacattcgcgaggaggacaaacaaaacattgtcacactcggcctgatcaatgatgatgaaaacgatgtagggaaggtgcatatcggcatcctttctgcgctccagttagcgcctgcagcacaagtcgaagtgaaagaaaaagatcaaatcgccgggcgctggatgaaactgagcgaactgaaagaggaaaatgtgtatcatcgtcttgaagcttggtctcggtttgtcgccgatatacttcaataacaaaaaacccccgttcgtcccaaaaagggagagcaggggttttttcatttagtcttgcacaatgaaggcatcaaatccggctttttcggcccgcgctgccaacgcttcagcataatctctgaaagagaatgcgccgatctgcactttaaataagccgccttttggaagcacaatcgcgtcaaaacctttagacaccgcatcggcggcaagcgcatcagcatttgctttcacgttgaatgcgccgatttgcactttatataagtcagcctttttttttagaccgaaagcttgctccaagcccttggcatgtcctcttgcaaggctttcaataaaactggctgttttcagtttgtttgcatcagctgacgtatcaacaaaaccattctccgtcaaaatcgccggcatccttgtctcccgcagcacatggaagttggctgttttttttccgcggtcattaaaacccgatgcttgaattacttgcgtgtggacggctgattggtaagtcgaggtcggcgctccgacaccggggtaaatatagctttcgaatccggttccgcctcctgagttaatatgaatggataaaaaataatctgcgccccagctgttggcggcatccgttctttccgtcaggctgaccgtcttatcgcttgtcctgctcatcgtgacagaaactccttcatactcattcgtcagaatcgtgcgcaaagccagtgcgatctccagcgtgaccgctttttcctgaagtccgtttccggttgcacctgaatcagttccgccatgaccggggtctataaaaattttaaccattctccatcacctcattacagcatatgatgatattcaaaaggtgcttgtacggctgtcattcatgaaaaaaatgagaaatacacccaacatttcccggaaaataaaaataaatggtttgtcctcccgtttttgctgaatacaataagaaatgaaaaatatttctcgggaaagcgcaggattcaacatcattcccgaagagaacggaaaaagtgacagataaagaggaaaacgggcctcatgatgataggcggatgtcacagaaccgcttcatcatgagtaagataaagagagaacagagaggtgagcatgttggagcgcgctgtaacctataaaaataacggacaaattaacatcattcttaatggccaaaagcaagtgctgacaaatgcagaagctgaggcggaatatcaggccgccctgcaaaaaaatgaagccaagcacagcattctgaaagaaattgaaaaagaaatgaacacattagtgggtatggaagaaatgaaacgcaacattaaagaaatttacgcgtggatattcgtcaaccaaaaacgggccgaacaagggctgaaagtcggaaaacaagctcttcatatgatgttcaaagggaaccccggcaccgggaaaaccaccgtcgcgagactgatcggcaagcttttcttcgagatgaacgttctttccaaaggacatctgatcgaagcggaacgtgccgatctcgtcggtgaatacatcggacacacggcgcaaaaaacgagagatctgattaaaaaatcgcttgggggcattttattcattgatgaagcatactcacttgcaagaggcggagaaaaggatttcggtaaagaggcgattgatacgcttgtcaaacatatggaagacaaacagcatgaatttattctgatcctggcagggtactcgagagaaatgacacatttcctgtcattaaatcccggtctgcaatcgcgcttccctatcagcatcgattttccggattactctgtcactcagctgatggacatcgcaaagcgcatgatagcagagcgggagtatcaattaagccaggaagccgagtggaagttaaaagattacttaatgacagtgaaaagcacgacaagccccattaaattcagcaacgggcgctttgtcagaaacgtgattgaaaaatcgatccgcgctcaggccatgagacttttaatgggagaccaatacttgaaaaacgatttaatgacgatcaagagccaggatttacttataaaagatgaggcggcagctcacgaatagacctctcagccggtttgaggggtctcttttttatttctctctttaaaacccgccggatgtgtggtatacgccctgcgggtttggtatgatagtactactgcccaatacgacacagaaaggaacatccatttgaacgaacaggaaggaaaaaaagaaacggtcattttggtcggctgccagcttccgcacatgacagatgagcactttgaacattccatggaagagcttgcttcattgacaaaaacggctgacggaacggtgctgacccggattacgcaaaaacggaacagagcggatgccgctacatacataggcaaggggaaagtagacgagctgaaggcgctgtgtgaagagcttgaagcggatctggttatttttaatgatgaactgtcaccgagccagcttaaatcactcgccactgcaattgaagcgaagatcatcgaccgcacgcagcttattttggatatattcgcaaaaagggcgaagacgagagaaggaaagcttcagatcgaattggcccagcttcaatacgcgctgccgcgtctgagcggacaaggaatcaatctctcaagacaaggcggcggaatcgggacgagagggcccggtgagacaaagcttgaaacagaccggcgccacattagaaaccgcatacacgaaattaacgtgcagctgtcaacggttatccgccacagaagccgttatcgggagagacgcaaaaagaacggcgtgcttcaggctgcactcgtcggttataccaatgcaggaaaatcaacgtggttcaatcaattaacaagctcagacagctatgaagaagatctgctgtttgcaacacttgatccgatgacgagaaagatggcgctcccaagcggctacagcgtccttttgtctgatacggtcggcttcattcaggatctgccgacgacgctgattgccgctttccgttcaacgcttgaggaagtgaaggaagcagacttgatcattcatgtcattgattcatccaatgaagattatgccgggcatgaacagactgtcctcggactgttaaaagagcttgaggcagatgatattccggtgctgaccgcttataacaaacgtgatgagacacttcctgacttcatcccgacagcgggagaaggccacatcatgatcagcgcccgaatcgccggggatgaagcgaaactaaaagcggaaatcgaagcttatttgcgccgggagctgatgacaccgtatgaagttcatgtgcctgccgccgaaggcaaattgatgtcacgcatcaaatcagagaccatgatcgacagcctttattttaatgaagaaaatgaacgctacgaagtctcaggttatgtacaggaagaacaaagcatactcggagaattgaagaaattcatgtaaggaaggtatacacaacatgtttgacacactgacccacggcgctcttttacaaaaaaccgccgaagaaacagaagcggaaatctccgccgttcataaaagaatagaagaaatcagtgaacggaatgaatggagagtcctgcaaagctacagaaaacataaagtaagcgatacgcattttacgccttcaaccggatacggttatgatgatatcggacgggatacactggagaagatctatgctgatgtgttcggaggagaggagggacttgtgcggccgcaaatcatttccggtacgcatgcgatttcaatcgcgctcttcggcgtgctgagacccggggacgaattgctttatatcacaggcaagccttacgatacactcgaggaaatcgtcggagtaagaggcggggagtattcaggctcgcttaaggaatttcaaatcggatacaatgcagtcgatttaacatcagaaggcagagtggactttgaagcagtccgggctgcaatccggccgaatacaaaagtgatcggcatccagcgttcaaaaggatatgcgaatcgtccatctttcagaataaatgaaattgaagagatgattcgtttcgtaaaggaaatcaaagaggatgtcattgtttttgtggacaattgctacggagaatttgcagaagagcgggaaccctgccacgtcggagcggatcttatggccggctccctgattaaaaacccgggcggcggccttgctaaaacgggcggctatcttgtagggaaagccaagtggattgaggcctgctcttaccggatgacctccccgggaatcggaagtgaggccggtgcttcgctttattcactgcaggaaatgtatcaaggtttctttctcgctccgcatgtagtggcgcaaagcttgaagggagcggtatttaccgcccgttttcttgaaaagctcggctttacgtcaaaccctgcatggaatgcgccgagaacggatctgattcaatcagttgagtttcaggaccctgataagatgatcgctttttgccaggcgatacaatatgcatcaccgattaatgcgcatgtgacgccttatccgagctatatgccgggatatgaagacgatgtcattatggcagcgggcactttcgtacagggagcaagcattgaattatcagcagatggacctatcagaccgccttatgtcgcgtatgtccaaggaggattaacctacgcgcacgtgaaaaatgcgatttgcagcgccgtaaatgctttaatggaaaaagagctgatttagggcgtttgcaattttcaaagaatttgatgttaagattccttacattgtgttgacacaaaatataacatcacctataatgagactaagataagaaaaggaggaaattgagatgagtgataacattcgccgctcaatgcctttatttccaattgggattgtcatgcagttaacagaactttctgcccggcaaattcgatattatgaggaaaatggattgatatttccagcgagaagcgaaggaaatagacgattattttcattccatgatgtagataaactgttagaaatcaaaaatctgattgaacaaggcgtcaatatggcggggatcaaacaaattctggataaggcatctgccgaaccggaagaaaaatccgaaaaaaccgccaaaccgatgaaacacaatctgtctgatgacgaactcagaaagcttctgaaaaacgaactgatgcaggcaggccgtttccagcggggaaatactttccgccaaggtgacatgtcccgattctttcattaatccgttagcaactgttttgctatatacatttaccttttagaggaggagttttacgaaatggcaaagtacacaagagaagacatcgtaaaattagtaaacgaggaaaacgtaaagtatatccgccttcaattcacagacattctcggaacgattaaaaacgtggaaattcctgtgagccagcttgaaaaagcacttgataataaatgcatgttcgacggttcttccatcgaaggtttcgtccgtatcgaagagtctgatatgtacttatatcctgatctgaacacatttgtaatcttcccgtggacggctgaaaaaggtaaagtagcacgcttcatctgtgacatttacaatccggacggcacgccgttcgaaggtgacccgcgtaacaacctcaaacggattctgaaagaaatgaaagaactcggtttcagcgatttcaatcttggacctgagcctgaattcttcctgtttaaattagatgaaaaaggcgaaccgacgcttgaattgaacgataaaggcggatacttcgacctggctccgactgacttgggagaaaactgccgccgcgatatcgtgcttgagcttgaagaaatgggctttgaaatcgaagcatctcaccatgaagttgctcctggtcagcacgaaatcgattttaaatatgccggtgccatccgttcttgtgacgacatccaaactttcaaactggttgtcaaaacgatcgcccgcaaacacggtctgcatgcgacattcatgccaaaaccgctgttcggcgtaaacggttccggtatgcactgcaacctatcactctttaaagataacgttaacgcattctttgataaagacgctgatcttcagctgagtgaaacagcaaaacatttcattgccggtatcgtaaaacacgcgacaagctttacggctgtcacaaacccgacagtgaactcttacaaacgccttgttccgggctatgaagcaccttgctacgtggcatggagcgcgcaaaacagaagcccgctgatccgtatcccggcttcccgcggcatcagcacgcgtgttgaagtccgcagcgtagacccggcggcaaacccgtacctggcgttaagcgtattgcttgcagcaggccttgacggaatcaaaaacaaacttgaagcaccggctccgattgaccgcaacatctacgtcatgagcaaagaagagcgcatggaaaacggcatcgtagatcttccggcgacactggcggaagctctcgacgaattcaaatcaaacgaagtcatggttgcagcgctcggcgagcacctgttcgaacacttcattgaagcaaaagaaatcgaatgggatatgttccgcacacaggttcatccgtgggagcgcgaacaatacatgtctcagtattaatctctcaatcccttggcactattggtgtcaggggattttttaagttttggtcaaaaggttaagaggtcgatattttggtccttgaccaaaaaaaatgaagttatgaatctaactccataattgaggacacgtatttattgtaatcccttattcggtttaggatggaggctaaatgaagccaattatgctctaaaattgaaccggccatttttattttcaaaaagcaggagcaggaaattcatcaattttgatacgaagtaaactataaggtttctgtcgtaagtcttctccataatgaaaactagcctgccgatgtaattggttcacgatgacgtataagtatccatccggaccaatcgaaaaagtatccggccataaaattctcggatcatgtgcgatggtttccattgtgccattcggcagcatctttcgaatactattgttctcgtaatctccggcataaacggctccttttgcatctgtaatcattccatcagacgcgcctttttctccccaatacgccacatgataaagtaaatccatgtccgatatatttctatctctcagggcttctgttgagatagagaacaaatggcggctggtcaggggacaaaaaaataatacctttccgtcgggagagatcgcaataccgtcggatgccagcctaaatggggaagttgaaccatccttgttacgattcatcaaaattttgccttctactttcggtataaaagaggaatccggtgaagttggatttgctccatttaaccgtctaaatgcgtttccggtttctaaatcaacgacgataatagctcctggtcctttggaagaagaatccgttatataggcataacctgcagttccgacacgaaaatcaaatcggacatcattcaggtaggttgttggaaggacaacatcttctgtaaaggtatacactcttctgattgtattggtttttaaatcaacagcgactaattttgccccgcctttaattggttcagaaaaattgggcgccgctgtatctagtatccaaagcgttcctcttccatcagcaactacactttggacactgatgaaagtcattttgatattctcaaagttaaccaaattggtttgtgaatcaggataaggctgcaatttatctccaattatttccgctgccgtaaatttaacatcgtctccccatttcggaaaacaaatgaatatacgaccggtttctgagacagtaacaccggtaggcatagctccataaaatgcataaaccagttctaaatcaccaaaatatttttcaaaaggcagcataggtttcataatatcctcctcaaccaattaaacgggatatcacttatatatgattcgcattttttcaagtgcatgtttcttaataagtttttctaaacaaaagatgatggaagtgcttatcatttaataaatcagtcaggtgacacatagggtttttacttaacgtctgtcgaaggagccggcaattacaacatggtatgtcctttgatcggttttaaattttctgaaaaaagagttgaaaaagcagaaaagattttataatatgaaatcaagttagtttgttcgatcaacaaactaataaaccgctttaattgtccttcatgtaaaggtcttaaatggaaggggataagaggctcgatttaattggaggtatatataaaacgaaagccaagcttttatcctgttcactacgatgaaagtgctctgtgaaagtaaactgctatcattttttgaaagcgcttttataaagacctcactggccgataaaattgaagaaatgttataccattcatcatgttccttatgtaaaggatcgaaaaggggaggaaatcatgctcagtgaaaatgtaaagaagatcagcatggttgaaaaagttggatatgcgtctggagattttgcatgtaatttaatttatgcaacagtgtctacttatcttttgttcttctatacagatatatttggtttaccggcagcaacagccggtacgatgtttttagtggttagaatcatcgacgctctcgctgatccttttattggaacgatagtagacagaacaaatagcaggtttggacgcttcagaccgtatcttttattcggagcttttccatttgtcatactggcaatactctgttttacaaccccggatttttcggatattgggaaattaatatatgcctatatcacctatgtcggtttatcgcttacatacacaatgataaacgtgccatatggcgcgttaacctctgcaatgacccgaaataatcaagaagttgttagtataacgtctgtccgtatgttatttgcgaatcttgggggacttgtcgttgcattttttgttcccttactggctgcttatttaagcgatacgtccggcagcgaatctcttggctggcagctaaccatgggtattatgggagttataggcgggtgccttttaatcttttgttttaaaagcacaaaagagcgtgtcacgcttcaaaaatctgaagaaaaaattaaattatcggatatatttgagcaatttcgtgttaatcggcctctagttgtactaagtattttttttattattatttttggagtgaattcaatcagtaattcggttggcatctattacgtaacgtataatttagaaagagcggatttagtgaagtggtacggtttgttgggaagtttgcctgctttggtcattttaccgtttattccaaagcttcatcaattattagggaagaagaaattactaaactatgcattattactgaatatgatcggcctcttagctttactgtttgttccgccaagtaatgtattcctgatactttcctttcgattgctggccgctgcaggaagtctcactgccgggggatatatgtgggcgcttattcctgaaacaatcgaatatggagagtataagaccgggaaaagaatgggcggtctcatatacgctattatcggatttttctttaaattcggcatggccttgggaggggttgtaccgggtttggttctagatcagtttggatatgtggcaaatcaggcgcaaacgccggaggcattgacgggaattttaattacagcaaccattattcccgtgttcttactggttctggccatgattgatattaatttctataacttagatgagaaaaaatataaaaacatggttcgagaattagagaatagagacaaagtttatttggatcatattgacgatttcaaagcttaaaacatgatagtcaacagaaaatagctgaggaggcgttctgcatgaagattatcaatccagtacttaaaggattcaaccccgatccgagtatttgcagagtgggagaggattattatatcgctgtatctacatttgagtggtttccgggagtccagatacaccattcaaaagatttagtcaattggcacttagttgcacatccattacagagagtttcgcaattagacatgaaaggaaatcctaattcaggcggggtctgggcgccatgtttaagttacagcgacggaaagttttggctgatctatacggatgttaaggtcgtagatggcgcttggaaagattgccacaattatttagtgacttgtgacacgattgatggtgattggggggagccgatcacattaaacagctcggggtttgatgcttctttgttccatgatacggatggaaaaaaatatttattaaatatgttatgggatcagcgtattgatcggcactcctttggaggcattgtcatgcaggaatattctgataaggagcaaaaactgatcggtaaaccgaaagtgatatttaaaggaactgaaagaaagctgacggaagcgccgcacctttatcatatcgggaactattattatttattaaccgcagaaggaggaacgcggttcgaacacgctgctacaattgcccgttctgcaaatatcgaggggccatatgaagttcatcccgataatccaatcttaacgtcatggcatgatccaggaaacccattgcaaaaatgcgggcatgcatccattgttcacacacatacaggcgagtggtatttagctcatttaacgggacgtcccattcacccggacgatgattcaatttttcagcagcgaggatattgtcctttgggcagagaaacagctattcaaaagctctattggaaagatggctggccttatgtagaaggcggaaaagaagggagcttggaggtggatgcgtcttctatacctgaaaccatatttgaagacacgtatccggaagttgatgaatttgaggatgcgacattaaatattaattttcaaacgttaagaatcccttttacggagaaattaggttcattaactcaagcgccaaatcatttacgattatacggccatgaatccttaacttcgacatttactcaggcatttgtagccagacgctggcaaagtctccattttgaagcggaaacggctgttgcgttttatccggaaaattttcagcaagccgctggtttggtgaactattacaatacagagaactggacggctcttcaagtcacgcatgatgaagaacttggccgtattcttgaattaacgatatgtgataacttctctttttcacaaccgttaaaaaataaaattgtgattcctcgtgaagtcaagtacgtctatttaaaagtgaatattgaaaacgaaaaatattattatttctattcatttaacaaagaagattggtacaaaatcgatattgcattggaatcaaaaaaattatcagatgattacatccgcggcgggggattctttacaggagcttttgtagggatgcaatgccaagatacgagcggaaatcatattccggccgacttcagatatttccgttataaagaaaaatgaatgtccgcatgaaaaaggagctttctattttggaactcctttttcatattagaaaatgcccgtgtggaaaaacacgtcagaaatgctcccattcaggatgaaaataacaaaacaaaaaacccatctttaaagatgagcgtaaaacatagaagtttgtacatttcagttatgaaccatgtcgagaaaatgatcaatcacaatagaggacattcccaatgccggtgcgttttttcctaggatagatggtaataattcatagctattgtctaggtgggaataaaccctggacgatacttcgcttttaattgaatgtaaaactataggatgcgattcgatgatgctgtttcttaaaatgatggcttgcggattaaatgtatttaaaatattggtcaggcctatccctaaatagaatccaaaattctgtaatgcatgtaaagttccaatatcattcagatgggcgaggtctatgatatcttgagtggacacttttttctcttttgtctgaagagatgttaataaagccttttcggaagcatacaattcccagcagcctcggtttccgcagctgcatttcggaccattaaagtctattgtcatatgtcccatttctccagagaatccgcttacccctctgtataaatcattgtttataataacgccgattcctatccctgtaccgatacttgcataaatcatgttatcgtgatttttggcagcaccaaatactttttctccatatgcgccggcatttgcctcattttcaataaaaacgggcacattgaacttcttttggatgaaagattttaagtcaatatctctccagttggagttcggagcgaaaacaattttttgatttttatcaattaacccgggaacgcatatgcctataccaataagcccgtacggagattgcggcatatttgcaataaagtgaagaatcatctcaattaaaatatctttcgttatttcaggagagctgcattccaaatggtggtgttgatcaaggacgatcgtcccttcaagatctgttaaaatgccattaacataatccacgccgacatctattcctacggagtatcctgcttttctattaaaaacaagcatgacaggtcttctgccgccgcttgattgtccctgaccgatttcaaatacaagattttctttcattaatgtgtttacctgtgatgaaacagttgatttatttaatccggtcatttcagataattttgctcttgaaataggagaattcttaagtatttcgtttagtaataacttttggttaacttttttgacaaaggcttgatcagcgatatccacttcatccactccgtttgtataatctttaaattaagttgaacgttctgtgttatcgtgcgaaacgcagtacatagcgaatccaacctttattatatctaatgtgttcgtaaaaaactaaaaaaaatattgaaaatactgatgaggttatataagatgaaaataagttagtttgtttaggcaacaaactaatatataacatgacataaaatcatctgtattcgaatcatcaagtttagaatttatttttaagggggaaatcacacatggctcactctcattccggttcagtcaactattttgaaagcgtaaacaaagtgatttacgaagggaaagaatccacgaatcctttagcatttaaatactataattctcaagaagtaattggcggaaaaacgatgaaagagcatctgcgattttctattgcctattggcatacatttaccgctgacggcacagacatttttggcgcagctacgatgcagagaccgtgggatcactataaaggcatggatctggcgagagcgagggtagatgcagcgtttgagctgtttgaaaaactggatgcgccattttttgcttttcatgaccgggatatcgcaccggaaggaagtacgttaaaagagacaaatcaaaatctggatataatcgtggacatgataaaagactacatgagaaccagcggcgttaagttattatggaatactgcaaacatgtttacgaatccccgtttcgtccatggtgcggcgacttcttgtaatgcagatgtatttgcgtatgccgcagcccaagtaaaaaaaggattagaaacagcaaaagagcttggcgccgagaactatgtattttggggcggacgtgaagggtacgaaactttgttaaataccgatttaaaatttgagcttgataatatggccagatttatgcatatggcagtggattatgcgaaggaaatcgggtatacagggcagtttttgattgaaccaaaaccaaaagagccgaccacccatcaatatgatacggacgcagcaacaaccattgcctttttaaagcaatacggcttagacaatcattttaaattaaatctcgaagccaatcatgccacattagccgggcatacattcgaacatgaattacgcatggcgagagtgcatggccttctcggctctgttgacgcgaatcagggtgatccgcttttaggatgggacacagatgaatttccgacagatttatattctgcgacattagcaatgtacgaaatcctgcaaaatggcggtcttggaagcgggggattaaactttgacgcaaaggtcaggagatcttcttttgagcctgatgatttactatatgcccatgttgcagggatggatacatttgcaagagggttgaaagccgcccacaaattaatcgaagatcgtgtgtttgaagatgtgattcaacaccgttaccgcagctttactgaagggattggtcttgaaattgcagaaggaagagctgattttaagacacttgagcaatatgcgctgaacaatcagccaattaaaaacgaatcagggagacaggaacggctaaaagcgatattaaaccaatacattttacaggtataaccaaatgaaaaaagaagctccagatcccgcataaaagatgcaggcagccaagttcccggaattgcccgtcatgaagttactgttatggcgggtcatttcaacggaaatctatttagagaggaaggagtgaaaaaatgaagtatgtcattggaatagaccttggaacgagtgctgttaaaaccattttagtcaatcaaaacggcaaggtttgtgcagaaacgtccaaaagttacccgctcatccaagagaaggcgggatatagtgagcaaaatcctgaagactgggtgcagcaaacaattgaagcgttggctgaattgatttcgatatccaacgttcaagccggggatattgacgggattagctattcaggacaaatgcatggattagtactgcttgaccaagatcggcgggtgctgcgtcatgcgattctttggaatgataccagaacgacgcctcaatgcagcaggataaccgagacatttggcaatcatctgcttgatatcacaaaaaatcgtgtccttgaagggtttacattacctaaaatgttatgggtgaaggaacatgagcctgaactttttaacaaaaccgctgtttttctgcttccgaaagactatgtgagattccgcatgactggcgccattcacaccgaatactccgatgcggcgggaacgttacttttacatatgacccgcaaagagtggagcgatgagatttgcaatcaatttggtatttcagcagaaatttgtcctccgcttgtggaatcccatgactgtgtaggatcgctgcttccgagcgttgcggcgaagacagggctgctcgaaaaaacaaaagtgtacgctgggggagcagataatgcttgcggtgctgtcggagccggtattctttcttccggaaaaacgttatgcagcattgggacgtcaggagtcatactttcctgtgaagaagacaaagaaagggattttaaagggaaagtgcacttttttaatcatggaaaaaaggattctttttatacgatgggggtcacgctcgctgcagggtacagcttggactggtttaaaagaacgtttgcgccgaacgaatcgtttgaacaattattgcggggggtggaatctgttccgataggagcaaatggactgctgtacactccttacttagtcggtgaaagaacgccgcatgctgattcatctattcggggaagcttgatcggaatggacggagcccataaaagagagcactttttgagggcgataatggaaggcatcacattctctttatatgaatcaattgagctattccgcgaagcgggaaaatcagttgatacggttgtctctattggcgggggagctaaaaatgaaacgtggcttcaaatgcaggctgatattttcaatacgagggtggttaagttagaaaatgaacaaggtccggccatgggggctgcgatgttagctgccttcggaagcgggtggtttgactctcttgaagaatgtgcagagcagttcattcatgaagcagctgcattttatccaaaagaacaaaatgttcaaaaatataaaacactattcgagttgtataagaacatttacgttcacacaaaagatatcaatacagctttaaagagctttagacaaacctaattttcaggaggtcaaaggaagaacaataaacggccactcattatcaatggccttggttttataaatctgttaacaaatgagaaagccggcattaataaaccatggaatgcaattctttctcccgcgcaatacactaagcgattacagtttagggatatcaaagcagcggcagcgctaatataacttcaaatgtgttaacactattgaaggaaacagataagcattcttgtaagttgtgactgcatcagtctaaactcatatgacgatgaaatgagaagtatacacacaaaacatcccctcacattgcgtgggggatgttttttattattgagattttcctgtttcttgaatccgtggggatagcctttctgcaatggattcacaggtatcactcaacttcaggatttccttagaaaatgaagaaagaacctcgccaaattggccaggttctttttatattgcacaaaaacagacacggtgatataatcagaacacgcgcgctttctgtgttaaaagtcatagttatccatcttatattatgattatatcatgctgaaaagctcttgtcaaatttttttgaaggggagatatagaatgagttctttggttctcggcattcacgaaattgaaaaaacacagcctttgctcgttggaggaaaagggttacatttaggggaattatcaaaaattcaaggaatacaagtaccggaaggattttgtgtcacaaccgccggatatcgaaaagccattgaacaaaacgaaacgttacaagcgctgttgggtcaactgaccatgctgaaagcggagaatcgggatcaaattggtgaagtcagcaaaaaaatccggcaaaccattatggaagcagaaattccttcagatgtagtcaaagcagtcgcttgccatctctcccggttcggcgaagaacatgcctatgccgtacgttctagtgcgacagctgaggatttaccgcatgcctcttttgccggtcaacaagacacctatttaaatattaccggcgtcgatgcgatcttgcagcatatcagtaaatgttgggcgtccctatttacggatcgcgcggtcatttaccgtatgcaaaatgggtttgatcacagccaagtttatttatctgttatcatccaaaggatggtgttcccccaggcttcggggattttatttaccgctgatccgatgaccggaaaccgaaagctgctgtccatcgatgccggttttggacttggtgaagcactggtctccggcttagtatctgccgattgttataaagtacaggacgggcaaatcgtcgataagagaatagaaaccaaaaaaaaggctgtctatgaacgaagagaaggcggaacggaaacacgggagatcgatcttgatcagcaaaagattcaaacactgactgatgaacaaattttacagctggcacgtatcgggagacagatcgaagctcatttcggccagccgcaagatatcgaatggtgtttggaccgcgatactttttatattgtccaaagtcgtccgatcacaacgttataccccgttcctgaagcgaacgatcaagaaaatcacgtctatatctctgtcggtcatcagcaaatgatgacggatcccataaaaccccttggattgtctttttttctgttgacgactgctgcacccatgcgtaaagccggcggaaggctatttgtcgatgtcacacatcaactggcatcccctaatgtcagagaagttttcttaaaaggtatggggcagcacgatccgctcttaaaagacgcacttatgaccataatagagcgagatgatttcattaaaccgatacatgataaaacggcgccgattcccggcaaaggcaatgcagatatgccggatcaagctgaaaacgatcctgcaattgtttctgatttgattaagagcagtcaggcatcgatagaagagttaaaacaaaacatccagacgaaatcaggatctgatttatttcgttttattttggaagatatccaggaattaaagaatattttatttaatccaaaaagttcggtgctgattcgaactgcaatggatgcttcatcatggattaacgaaaaaatgaacgagtggttaggtgaaaaaaacgcagcagatacgctttctcaatctgtacctcataatattacttcagaaatggggcttgcgctattggacgtcgccgatgtgatccgtccttatccagaagtaattgcctatttagagaatgtaaaagatgatcactttttggatgggctggtgaagtttgaaggcgggcgggaaacccatgacgctatctatgcttatctcaacaagtacggaatgcgatgtgccggagaaattgatatcacaagaactcgatggagcgaaaaaccaattgcacttgtccctatgattcttaataatctcaaaaactttgagccaaatgccagccagcggaaatttgagcaagggcggcaggaggcgttgaagaaagaacaagagttattagaccgattgaagcaattaccggacggtgaacaaaaagccagagaaactaaacgaatgatccaaatcatccggaacttcagcggattcagagaatatccaaaatacggcatgatcagccgctacttcgtttataagcaggctttactgaaagaagccgaacaactcgcaaaagcgggggttattcatgaaaaagaagacatatactatctcacttttgaagaacttcaggaagtcgtacgcacaaataaattggattaccaaatcatcagcacacgaaaaggcgagtacaaagtatatgaaaaactatctccgccgcgtgttatcacgtctgacggtgaaatcgttacaggcgagtacaaacgagaaaatctcccggccggagcgattgccgggctgcccgtttcctcgggagtcatagagggcagggcacgggttattttaaacatggaagatgccgatttggaagatggggatatattagttacccctatactgatcccagctggacaccattgtttgtgtccataaaaggcctggtcactgaagttggcggactgatgacccatggagcggttatcgcgcgtgaatacggcttacctgcagttgttggagttgaaaatgcaacccaattgataaaagatgggcagcgaatccgcgttcatggaacagaaggctctattgaaatattataatagcgggtgtgtgcacgtcaccagatatttcctgcatattaactgacaaataccgaacaaaaagaaaagccggaaccttttagaagaggaatccggtttttttatgtgaaaatgatttaatgtgtgaacaccgcattttgtgggcggacccttacaaaaaagattcagtgactaaatctaacgatgacaattttataaaggtgagtaatatcctttttaagttcacaacctctgtaatcctgatgaattaaaaacgccttagttttttaacaactatttaggggttttgttcatgaacaagtctttattccgaattgaattgttcaccttattcttcatagcggcaatattggcgcaggcaggggagaaaactctcccgcttaccagagtgaaaataaaaaatgtttatcttagatagatttttttaaaaagtaaaaacgccataaaacttcttatggcgtctgtccgaactaagggatgcaatgtttgggagacgaatataaatcgtcaatgtgctagaaaaggaatgcagcacctacaatgattaacaaaatgaacagcacaacgatcaatacgaaagaacttccaccgtaatttccaccgtagttccccatattattgccacctcctgttgttaggatagtacataatatgccggacgataaatttcgacatagatttaagtctaaataagaaaaaatggatattaagtctaaaatgaagagcttctaagaatatgaaataatggaaagagagaaatggatgggacggtttgctgtttaaagaggagggatatggctcaacatgcaataaaactgtggatgaaagtggtgagccatgacgttacttcatcatgcagagccacatacgaagaggtacagggaaattatagttaacgaaaatattcatcatttcccgggcaagcgcagtatacgacaaatcaaaacaaatcacaaagggacggaaggtacgatacaaggaggctgcttgcgggtttgtggtgcagataaagtttccgtttcaaaaaggtcatatgtttattcgacactttacgtttattcctgcagaatgcttggaaaagaaagtcggcaaaactgccgactttcctaacggaatttagatctcaacagatctaaagaaaccatcgacactatcaccggtgccgctatcatatttcaggatgtattctcctttttggttaacgctgaattcttgaatgaacgttttccccgcatttagtgtcgtagaggataagagtgtattcccattaggataattaatggtgaatttgaaagatttgctgccgtcattcgctacaaaaactctgatttttcctggagagctgccttgatagttgaatgaaatcttaccggtaccgccagaaaaaggctgacacgcaatatacggagcgtcacatgaccaaccggcaggtttcatgactttatcttgatttggcaaagattttgcagaaacatctgcagcccccattagcggaattaacccaaaagcaagagcgccggcaataattttctttttcattcgtattcctcctcttaatagtgaatgtgatacagctataaatttacaatatttataaaataattccttctttttcaagttgagagaagaagaaaaatttaaagaggacaaataagtgtcacaaattaacaatccatgcactgcagtaaactggtcaaagcatgaagatgattttacgctaatgttttacaaggcgatcttctcactgtgagttaaagaacaagacgattgttaaccctgtgcgggtacgtaacaactgaaagaaagtaaattcccggacaaggagtatttctttaacctgaaacttttataaagcattaacgtattactttataaaggtaaataaggaggcttctgaatgggattaaaaaatttctttaatactgagttaaaatgctctatctgcggaaaaacattaaaatcaggggatgagataacagcttatcttacacttccgagtgagaagaagatgcctgtgggtagaatggacaaagtgttaagcaaacactctgataaggtctgctgtaaaaagtgcagtgagtaggtttttagtgttatgaggaacctctggtgggtttcctcataacagctacgcttcggcaatgaatgacctggaattatattggtatcagggttagtccaggcagtacttgcaaaatgtatgtccgccgaatggtctgtaaagtttcttttctgaactaaatgacaaagtcttattcagtctgggtggggcgctgagcaagaatagagattaaaggctgccgtatcattcccggcagccttaatgattaggaagtaaaatcgataaccatgcggccggtcactttaccttgctccatttcttcaaaaatatcattcacatcttcgatcgggcgttttgtcactttaggtacaactttaccgtccgcagcaaattgaaaagcttccttcaggtcttctctggtacctactaatgaacctactacctgaattccatctaacacaagacgtggaatatctaaatccattttgtccaccggtaaaccgactgcgactacacgggctcctgcttttacaacatcaatcgcttgattgaaaggggttttagagacagccgtgatgaccacagcatcaagccctaaatcgttagtcacttcttttgccttagcgacggggtcttcgtttaaactgtttacaaccgcatcagcgcctaagctcttagcaaaattcaatttttcatcgctaatgtcgaaagcaatcactttagcgttaaagacgttttttgcatattgaacagccaagttgcctaaaccgccgactccaaatacaccgatccattgacctggtttaatttcactgactttaaccgctttataagttgttacacctgcacaagtaatgctgcttgctgctgcaggatccaaattttccggcacctttattgcgtaatcgaccgctacgattgcttcttcagccattgcgccgtcaactgtatagccggcattttttacatcacggcacaaggtttcacggcctgttaagcaatattcgcagcggccgcagctttcaaacatccaggcaatagagacgcggtcgccctttttcaggcttgttacgccttcaccaatctcagtcacaatgcctattccctcatgacctaaagtgacgccggtaacatccccgaaatcagcatttttaacatgcaagtcagtatgacatacaccgcagtattccatcttaactttggcttcaccatgccgcaaaggacgtaattctttttgtacgatcgctatacttttgtcttttgttgctactactgctttcaaatcatacacccctttcaaatattcgcagaaaatttttacttatcttacaatttagcacacgactcttcttttgaaaacccttacatttttgcggacaagtgtctctacaaaaattgagggagctatgcagggaggattctacggatgatttgtcatccgaagggtgtttaaatgggggtttgtcatctccaaatgcacagaatgctttgaatttgcggtcataatctttctatagatatttgacttgcactgcagagaattacgccgtcaggatatgattttacccttagtgaaaagaatttcacgggtgatcatttgaacttgagcgcggctgataaggtgaatggtgatgcaaacagaaatcattacttattggtcacaaaaggagccggctgcggagatgtgtggatttcacggatttgaacacgatgagccggatgcagattggtgagcgatacacagtcaaggtatttccttgaccttttttatgggtatactgataattaaaagtaatcatagtatactaaagttacaataaaagtaacgaaatacaaattttaaggagttgcataaaatcattcttttaaagagaaggggatcaggttggatcagttaataaatcctacgaaacattctttttattttaggctaagtaaacatgactgttataaagttagaacaggaaagtgctccttagatttaactgataaggaatttaatgctttagaaggcgaagagcatgaatatgcattaaaatgcagaagattggctgcgcactacataaaaccggacatgcataaaaaacattcaggaatatatgcaagcgtaaatgcttgcggtcatatttcgtttagtgatggtcagcacaggatgtgtatctgcaaaaggtcaggtgtcgataaattacttattcatttatcaaacaacggagattatatatgtcatatatgccaggacaaaaacaaaaaattaacagttaaagaaaaattgaagcaaaggttttttaaaaaggattcgaataaacttgcaagagaaaatgattttattgatgatgagttttttgattaaaccaatcttttatttcaaatggaggggtacatttgggtatactcaactttttcaagaacaaagttaaaaatgaacaaaatgagaataaaaataataatatgaacactgttggcgttaataacgaaacagagatggtatcgaaaaaagaaaatttcccaatcttgattcaagagacaggcttctcaaggaaatatgaagaaaagtctgcatttttcgagtatatagactttaaggttgcaggaacatcacactatcaaaaagatattaagaaagccatcaagactgaggatgaagacagctttttcttcgatgaaaaatatgatggtatgacaaataaagagattctagaatcaacttttgatgagccgatatttatttatcataatttccttttctcaaattgtgaattgcggttagaagagaacaacaagtacgatccggaagctatagctgtctatgtaaatgattgcaaagtaggacatgttcctcgaaagaattttcaagaaggcaagaaatacatttacgatcagttaaagagtggtataaggcacccgatatcagcaagtttgtatggagggaaatataaagttaaccgcgatgatacaaagattgaaacaggagaaacagattataaaattgaatgtcaaatagtgattaaaacagacaaatagacaataaaactacgatattgtaagtgcgaagtaaatgaacggggcggtgacttgaagctgaattcaacaagattaaagagctatacctacacattggctttttcaagtttgtcgtatggtttgattttcgggctatatatgtttgtatactcgggttttgtgccaattgcattggttactgtagttatcattgctttttacgcattcattacttactttttgtttgctgttcctgtgcaactatggctaagaaagaagcctaaaaagtttagtttggttcatcttttcatttataccgcagtcgcttttttagctgtgttcttgttctggcacataggtaatccgtcaattgatttcacggttttcagaagtttcatttattacataatgagcattgctgctgcgttcatatattggtactgggactctatatttctgagaaattacaatgttcatcggaagtaaagctgatgtttccaaaagaaagcgggtgaggaaaaatggaatacattgagttgaccagggacaatattgatgacaatcatatttgctgtgcgttaggtacgaaacaatatgaggatgcggtaaatgaaaagaagagctggctcaaagatcggatgagtgatggcttggtgttctaccgcctaaacgaacgggccaaagtttttattgaatatttacctgcagaagaagcgtgggtcccggtaagcgcacctaattttatgtttattaattgcctttgggtctcaggtaaatataagaataacggacatgcaaaacacttgttagaaaaatgtgtgtcagatgcaaaatcccgcggtatggatgggatagttcatatagtggggaagaaaaaactcccttatttaagtgataagcatttcttcgagcatatgggatttgctgtgcaagatgaagcagaaccctattttcagttgatgtcactgacgtggaatgaacatgcacatcctcctgtatttaaaaaacaggtgaaaagtaattccgttaatgatgagggaatcacaatattttatacagctcaatgcccatttgcagtcggagtgttaaagcatttaaaggaactgactgaaaagaaaggacttcattttcaggccctgagaataacgtcaaaagatatggcgcaaaaatccccggcagtttggacgactttcagcatgttttataaggggacatttctcactcatgagatgatgagcgtaaataagtttgaaaaaatactcaataagcttttaatggcttaactttgttttattactattgctcgtttttatattcgatactgagggtttttcacgaaaattgttcagtactttacattgcgggcggcaaatgaatgattattgtttttgacaaagatgataacacccatcattatagtaaaaatagattgtgataagttcttcaacaaacgaagaagttcttttcaaaggtcgataacaatgaaacaggagactgcaaatgcaaaaaattgaaacccatcgcttaattttaagaaattttaccgagagagatgcacaaggtctgttggaatattcggcacatccgagagtgaattgttttcttgatgacagaatatctacgttagaagaagctgccgtaaatgttcaaaaaagaagccgagatgactcttatattgcagtttgtttaaaagacagtaatgatctagtcggagaactattttatttaaaagaagagccagatacctattccgtttgttggaatttcaatgcccgttttgaaggggcgggatacgcaagtgaaagtgcgaaggctttctttgagtatctctttatgcaaaaagaagcaagaaggctttatgcatatgttgaagatgataactgcaggtcacaaaaactatgtgagagattaggaatgcgtaaagaaggttattttcttgaatttatttcatttactgcccacgaggatggaacacctaaatatgaaaacacttaccaatacgcattgctaaagaaagaatggttaaaacaaaaacataggtaatagaatttgtggggaaataatctcccctttaccgaaaaaaccctgctgaaagcaggtttttttgtatttaggttacctagtaacgatcaaaaagattcagcttgaaggttgggaaaaacatgaaaatcattatagcaatgttgtaaaattagagagaggatgattgtgacggacattttgcagtttagcgacagaaggtgcaggaagtaatttgaatcagcaatgttcaattcattttgatgaatttaaagaagcgcttgataatcaaaatgtgaaaagcagttcagagtcaagacccattttgcggtgagaccggaaatatgctcttcatcttctgatgttgttcaaagctgacacctcttgatgcttatgtataagaaaataataccattgaaatatatgtataaggttggaaacggaggggatcaaagttggtgcgatcttgtgtaaaagaaaggaccaggatgaatgtgaccagcatccaccctgatcaatggggttcacagtgttctatttcattgtattccaatcggaataatattacaagggtgaaaaagaaataagcggaatgttttcggcttcttctgtctctggagcgggaaacggaaagtgagatgtttgaatgaaaataaatgattatctgaaggaaaggtttccgactttaaaattagtgcccggcatttatcatcaatgggacgtgggacttcatttttctctcggcggcaatatgtatcaatttaatgaaagcggtgctttgaatcttgagtattttcagcttgttcatcatcaaaccgccgcacttttcaatgaactgtttgaacatagcgatgacatgttccttgttgccaacgtatataagcacaaaactcaaggtaatcatccgagaaaattaaaggtttatcagccgtttctgaagtgtaaggatgatttatatcggatccaggtgaagacctgcccctgtccgtttgaagaagatgatgcagaagaatatgaaatgcagcagttttctttattatgtaaacggaaagatctgcgtattccccaattacttaaggcagccgtccacgaagattttccgctgaagccaaggttcgggggctgttccgttgggtatcccgatgttttctttgtgaatatgacaaaagatattattttctttctatatgatgacagagggtgtgaagtcatcgctcttgatgccggaagaataggaaagctttatgatcaatatcacgattggattgaattggactgaaaacgaacacatgaattcgaatccgcttgtgccggctttgttcttgcctagtccggctgcatgagtataatgggcagaattgaagggcgccggaaactttttttcctctcataccggccttctgcatgttaagcttctgtatttattttgaataaattcctatttataaaacggctgaatagaataacataaaagcttttttacacagtgcaggaggagagaaatgtgagggctgaacaccgtgattgtatggaaattggaatttattcatttgcagaattatatcccgatcctctgacagggaaaacagtcagcgcaaagcagcggatagatgaattgatgaagctggcgaaactggctgacgacgcagggcttgatgtattcggggtaggcgagcatcatcgtcttgattatgcggtatcttcgccgccggccatcttatcagcgatttcacagattactgaaaatattaagctgaccagtgccacgactgtattatccaccgcagatcccgtccgtttatttgaggattttgcaacgcttgatctgatttcagacggccgggcggaaatcattgcgggacggggcgcatttttagactcgtttcctcttttcggttatgacgtaggccattataaagaactgtttgaagaacacattgacctttttttaaaattaaattccggggaagaatcggttacctggaaaggacgttaccggccgccgctgcgcgaggcagaaatttctcctcggcctttttgcggaagcattccgctatggttaggtgtttcggggactccggaaagcgcagaacgagccgggcgtgcaggtgcgggtttggcattggctgtactgagcggtgatccgatgtcatctaagccgcttgttgacaaataccgggaagcggcttctaaagccggtcatcctccggaaaatgtgaaggttgccgtgaccggacatatgttcatttcaaaaacgaatgaacaggcaatacaagaattttacccgtatcattcaaattactggtctcacgttcattcatatcacgggatcgatgagcctttaacgaagaaagattttgagcgggcgtccggaaaagaaacagctttatttgtgggaagttcacagcagatcattgaaaaaatcatgcatcaatatgagttgttcgggcatcagcgatttctcgcgcaaatcgatataggaggtatgccgtttaaaaaagccgcggaaaacatcgaacgattagcagcggaagtagcaccggttatccgaaaagaaacccgcaaatccagcgaatgaagttctgagcataaggggcgggccggtttttggcaatcgcggattcgacaacagaatcggcccggctttttctttatgattataaaaaacaaaggggaaagcgcgaacctcattgctttttcctatcaagaaaaggaaggtcatttcatcctctatcgtgaagtgtatataccgaaagggattttattaacaaaaaagggaggatgatgcagtaatgaagggtttggtcaaagctgcagttttaactgttactcttgggattggaggcgctttctattcaagtgatgcatctgcgcacgggtatataaaagagcccgtcagcagagcgtacatgggagctttagagaaacaaacattgggctggacggccgctgcgcagaaatatggctccgtcattgataatcctcagtctgtagaagggccgaaaggatttccggctgcaggtccgccggatggaagaattgcgtctgcaaatgggggatcgggacaaattgacttcggtttagacaagcagactgcagattattgggtaaaacaaaacatccgcggcggttttaacacctttacttggtactacacagctcctcatgcgacatcaaagtggcactattatatcaccaagaaaaactggaatccgaataaacctttgtcaagagatgaatttgaattaatcggaacggtaaaccacgacggttccaaggcagatacgaatctgactcataagatttttgtgccgactgatcgaagcgggtatcatgtcattttgggggtatgggacgttgcggatacttccaatgccttctataacgtcatcgatgtaaaccttacacaataatctatgaattactgatcggctgcatgttcatcggccgatctttttagttttaatgtgtgaatgaaaagggtaaaaacagcagagcgccataaacatttcatttatggcgccgtacgatcatggaggtgctgctgacatggatgcggaggtaagaggattcttaataaccgccgaggaaagaagccccaacgatgattaataaaatgaatagcaccacgattaacgcaaaggagctaccataaccacctgagaatcccatataatctcacctcctaaagaggattaatacatactatgccgaaatgaaaagtttgatagggatgctagtttactttttgaaaaaaggtttcttagtctatatttcctttacatggccatccgttaaaatgagtaaaaggaggaatcgtactgcttcctgtaatagaaacggataggctcatacattgagaagttgcgaagagggtgcgcagttggcttgtttttttaaaaatgaaaatgtaacacgctattaggattggaaccttttgattcaacggaacaggctgaagaaatgattggttggtttcaagagcagcagcatgaaaaaagtggatgtgatgaggaatagagaaaaaagatgcgaaaggcataatcggaaccatgtatcaaaacggactgcctggtgatatacgcgtatactccattccgaatgggaacgtaacgatctaacagaagaacttcaagtgttctgcggtaaataaaaaaagccgatgaaggcttaaaattgattagacgctgtaaagcattctttttgctgcgctttctgcagacggagtttgattgtaagaaacgattccgatcatcactaacaagataatgaaaaccaatatgctccacaacactatttttaaagactttgacatggcataccctcactttgaaagactttaccggggctgcgatcggagcccgcacttcaagtatagtcgttataacggtgaaaaatgtacagtatcccgttatcaaaataaaaacttgcgggcgctgccgcaagttttctctgaattaaggtctgtggaattcaatatgctgattatcacgatcgaaccatcctctgaatgcccaattgatccagcccccgtctcctttgttattaaaggaaccgtcttcgaagacccagattccgtaagtaatgccgtcataaacggctgatccgtaaaattgaacgccgttaaagcggtcttcatattcttgatttaaattgaacaccatgacgttgtacttctgtcctgatgcgtaaaatgttgtttccatgacattttttacccagccggttcggttttgatctgacttaactgcttcagctatgcgatctgcgattccgagaacatctacgtttacgttcagcccggcatcaacacctgctgcttttacgttttggcctgctgtttgggataatttactttctaacggatttgcaacgggtgaaacgtgaggcgcattcgggtgttcagactgactggctgctgaggcactggctgtgaaaggaattgttagagataaagctaagcatgatccgactattgttctggcgattttcatgtctatgacctcctgaggaaattttttaaaattgttgcaaattcatggtatcgcagaaaaattgaccaagcaaagagcagattttctcaaaagtcatgtcattctatttatgttgttttctgtaaatgaaatacttttaatcaggcgaaaagggaagaaaataatagagtctttttatgtattgtgataggatgaccggattttgggtgaaaatagcccggagaaacgtcataataagaaaaacacccgggatttaccgggtgtaaaaagtattgatatgtcaagtcagcagcattttttgcattttcttttataaacaacgatgtaatcataatcaagatgctttttatcttgtttcttctttttcttcttttgtttaggctgctttggctggtgatcataatgtccgttcatatccatacccatgtccatacccatgtccatactcatactcatattcctccttttttcatctgacggtagtattctatgacagaaagcatggatggcttggacaaatgaaacggtatgctgaaaaagaggcatctcattcggtataaaaaacaggattatacccgcccgatagaaaagagagaagatgatcctgatattgagatcctatttgataaccgcaattgcaatgccgtaccctttttcagcgctgtataaggccgtcagtttcaataccttccagccttccgcggctttagtcccgattccgttatgagccgtgatataatctcccgggctgaccgtactgtcgactcgtacgtaatgccggccgttgagtccgacaatatgccattcgtctctggccgcgcgtgcttcatagtcagcttcaagagccggactgcagtccgggttttgtttcggtacgcgtactgtttctcctgtttcttcgtcagtcacattttcgtatatgaaaccgccgaactcatttgtcaaaaagcggctttgccatccgaagcttgcggctcctgagataaaagcggctgtttctgaaatgacgccgagcatataatcaccgacgtgagccggttcaattttttcgcctttcactgtgacgatcgtcccggcgggaatcttctggccggttacactttcaaaatattctccgtaccctgacagggaagaggtgacagctccggcgaacgtaccgtggccgcccgctgaatccagtttccatttgatggactgatgccctccggcaaccgtgtatggttcttccaatgtaatgctttctgatgacagaatcgttctggagactttgccgcccgtaatatggacattgtttgaagcggcgataaatgcccttgaaccttcggaacttgaacctccggaagagctgatgatcgcatttctgtcacctctggccgtaatatcgcctgttcccgcaataacggcgcttgtcgggttgaatgcaaaaccggagctggtcgcgagctgtgcgcctccctttaaattgacggggatctgctcataagtctgtccttttatagatgcggcagcgctgtaaccttccgcttgcaccccgagaatgacagcctgactgttaggggacgtaattccgacggaaccgccgtctccgatcatcgtaccgttcataatatttacgttatattggcctccgccgattgtgatgcctttaggagaagacttgtatatatcaaaatttaaaattttaacataatcggttttattagatccgccggatatattgatgtcaaccccggcttgtgtaaagccgcgtattttaatgccgttgatcgtaatattttgactgcggtattgaagagccacgactggattcccgccatagtcgtatgagggatcaccaatagctgtgaatccgtttacattaacgtttttataggcagagatgaccagcgccctcggggttacaccgtcatagagggcattgaataccggttcaatcgcggtgcaatcggttaaagtaacatcataagccgtcgtgctttcggggtctgaggcctgatgatggccgatatgacgaatatcaaatgaacgtacatcacgatacgaaacatgaccgataatatgaacattttgagaagccggccacaggctgtgcgcctttacctcaatcccgcggatatttccgctcgtatagttatttaaaagccacacatgtttagagccgtcgtcaatttcaatgccgttcgagtttgcgctgccctcagcatgctctgtgccgcgggggtttccggaatggcagttggaaatgaaaatatattcgctgtaatgggtggtaatgccgtcgtctccggcgccgtatgccacacagttatcaatccatatataacggcagccgtctttcgtccattctgtttcaggcaaatgatcgtaagtcggagatgtaatatctataccatgcagacccgcgttaaccgtttcaacattcttaatccagccgtattgcacattagcaaacgttaaacagctggaacactgtcctccggggttcctgactccgcattgacggtcaggattccagtctaaagtcatgttctggacaaaaatattacggtttccattttcgtaatcatcgttagtaatgacccattcgtatgcgggagtgtcctcatgaagcttaagcacggtaatcccttgtccctcaccggaaatagtagtccatgaggggagttttatcccttgaaccaaaaattctcctgcgggaacatttactttgacccggccgttcccgatcgcattccgaaaggcttctgtattgtcccggccgtcagggaccgctccgtaatcctccacattcacttcccgggtgattttattcataagcatttcgtattctgtatcaagccgttcttttaaaagtgaggtgaccattccttccgccgtcacccgggcatctgcgatctcaagattatcatccgttgcggaatgcttaataaaattctgcatccttgctttgagatgctccaattcagagggctgtgcagggcgagactgcaatggggcgtttaaagacggatcaggaaagtttttaaattgaaccattctaaagacacctctttcttttgatataagcgcctgaggcaggggacagaaaagaatcgcgcgccctttaagcgcttattcttcaaattctttattcagaacgaaattccttttgaaaccgaggcgaaattttaaaaaagctctgttgaaaggaacggacatatagctttgcattattgtaattgaagctgtcatgtgaaaatggagggaaaaactgataggaggggtcctcattttaggtttattctcattgtcttcgccgtgcttcctcttcggctgcatatacaccaaaatcagcattcttatcagttaaatggtataatggggcacggattggtcatcaatacgactgaaatagggaagcaaaaggagcagcgaacatgactttacaaatcaaaattaaatattcagatgatacgcaaacgagaatcagtaaaattgaacagggcgattggattgatctgcgggcagctgaacatataacaatcaaaaaaggcgaattcaaacttatcccgcttggagttgcgatggaactgccggaaggatacgaggcccatgtcgttccgcgttcaagtacatataagcatttcgggatcattcagacaaattcaatgggagtcattgatgaatcttataaaggcgacaatgacttctggttttttcctgcattcgcgcttcgggataccgacatttccaagggggagcggatatgccaattcagaatcatgaagaaaatgcctgaagtggagctgatcgaagtagacaagctcgggaacaatgaccgcggcggactgggatcaacaggcacgaaataaaacgaaaaaaagactgcttaacagcagtcttttttttatggagacagcagttacattcaaattttttcggggattcttgaattgggaaatcaaacaaaactaaggagacgggtttcatttttatcatttaagctttccgtctctttgaacagaaagacttttttaggctaaaggatagaggttgttttgatgtttttattcttcaagatgaacggaggttttgtccaacgtatataatattgtgacaaaagtgtaaacaaaagaaaggatgatgttatggcaaaaagggttagaagagtagaccgtaaagcagccggcaaagaggcagagcagaagaaaccgtccaaagtcaccctgttctgccgttcgcttcaaaggctgaagcatttgtattgtaacataaacatacaaatgccatcaataaccaaaaaaggaatttcaattttaattttaccgtttttgcttctgccgttctttcgggctgatgccgcttcagatctttacggcagtttcgaggaattaaagctgaatgaagatccttccgatttttccatttcaacgcgggagcatgacccttctgtcctcatattagctatacacggcggaggcatagagccggggaccagtgagttagccagagaaattgccgaaaaccggagtttatatttatttgaagggttaaaatcagccggtaatgcagctctgcatttgacaagttcgcatttcgatgaaaccaaggccgtgcaaatggtgaaagggcactctaatgtcatttcattgcacggttacggcagtgatgataaaaagataaaaatcggcggtacagacagagaacgggccgaactcttgaccgatgtgctgaaacggcacgggtatcctgccgttcttcttggcacaaatgataaatacgcaggcgtcagtccgaacaaccttgccaatcaatcttcatccggattgagtattcaaatcgaaatgagcaccggcttcagaaaatcactatttgacacctttacgctgaaaagcagagcatccgcacaaaacgggaccttttaccaatttacaaaaacgatttctgattttatcagtgacaattattaataagcacgcttattttgtcggcggggctttttcttttgaaatttatgaaactttaagttcttaagatcgtatacataattgacaggatgaaagaaaagaggtgggcaaatgaaagtgatgatcgggtctatcattcttcttgtcatcatcggattcggtttatggctgatgcttagtccaatctttaaacaagtgggaagcggagccaaaaaattaaaaaagtcatgggaggaagaagatcagcatgagcgaaaataagcgcggaaacacaaaaaaaattctcggcggtgtgattataggtgcagcccttttaattgcgggcgtcacagcgtcactattcattgaaaaaataccgaacggttatgtcggggttgtatactcaccgaatggcggggtaaaatccgacacattggaccaaggctggcacttagtcggattatttaataaagtaacggaatatccggtgcgtatgcagacagtgaataatgaaaatataaaagtggcaacctctgatggtaaaaatatagaaatggatatcgcttacaactatgtcgtgcagcctgataaagtagtcgatctgtttaacaaattcggggcggtagacgtcgaaacgattgaaaatacatatttaaaaacaaggctgtgggatgcggcgcgaaaatcaatcagcaaatactcggttattgacacatacgggcaaaaatctgctgaagccgcggccgatgttcaaaagagatttgctgatgatatgaagagtctcggatttttaattgatgatctgacgcttggcgtaccgaagccggataaagccacacaggaagccatcgatgcaagggtgaagtcttcacaggaacttgaacggacacaaactgaaattaaaatagccgaagccgaagcgaaaaagaaaaaaattgaagcggaagggatcgctgactataacgaaatcattaagaaatcaatgtccgatgaaatgatcaaatataaatggattgaaaaatgggacggaaaaacgccgaaagcgacaggcacagactcactgctgcagctgccgcttgacgatcagaagcaaaagtaaaaagaggaggaggcgattgcctcctttttatgttttttcctgagggtctttttccggcactaattcttcagacgcctcggtttgatagctccatagcgtgctatccgtctctgttgtgtccttataatcttcgggaagtacatattgctgcaaataccggtgaaaaaatgcctcaaaaacagaaatgcaaagtgcagagataaccgctgccgcggcaggagagacattaaacccgccaatgttcatcaggaatatccataatataatgaatgaaattccgaaatcagctgcaacggctgtgaaattgcttgttctcggcagaatcatgcaatcacccgcaaaataagtgattaaacttaagatcactgtaataaacagaacgtttaaaaaggttacttggtacataagatccagaacaatgtacagtaaagcaagtgtgagcgccgttttagaagcgaaagcaattacgtgtttcatttgaaccaccttcgttatttcgtttagtcttcattgtaagcaatccgcaaatttttaaacaggtatatagtggttataaagtaaaatgtgaatagacatcacaggattcacaagttaaaatatgtaaaaagggggatgcaaatgaaaaaatactggatatgtattgctgtttttttattatgttttagcggaatacactcagctaaagcggctaccactgaattcggatcaaaaacaagcttcactttggagggaaacgcaaaagagtttcatattgaaaatccgggtgctgtagctgccgacgattactttttaggctataagttcaccataatgaacaactcttcgtgcggtttaagcatgaaactccagcggatggcgctgaacggaaatttttatacattaagttctaaaaactacagcggcagctggttaaacctcagtgcccaagataaaaaatcaattgatccgtatcacaaatacaggattctggttgaaagttcttcaaacgtctgtggtcccgtctatattaaagggttctacggtgtagaatattatcattttgattgaaaatagatactcgctaaaggcagcgggtttttttatatttatatttaacttattgcactatgtactaaatattcatatataaattttttgacgtgcccgcccaaagaaaagataaaaaagcaaattcatcacgcacaaatatataaaaagttgaaaaatgaatgaaaagtttctcgagggaaacattattagttgacttcaaaagtgcgatgtcggataataagaatgtaagtttttcctccttagcaggttcgtttcttaagccagggcgaatctgctttttttatgcaaaaaaaccccttacagaggggttttttacgataaatgaagtttaatagaattaatggacggctctgaatacgccgatcactttccccaaaatgcttacgttttgcaggataatcggctccatcgtcggattttccggctgcagccgcacataattgtcttctttatagaagcgcttgaccgtcgcttcatcatcttcggtcatagctacgacgatttctccgttattggccgtgttctgctgtttgacaatgacgtaatctttgtcaaaaatgccggcgtcaatcatactttctcccatgatttctaacataaagacatgttcgcccggaggaaccatccggtcaggaagcggaaaatactcgtcgatattttcaacagccgtaatcggaatacccgccgtcactttcccgatgaccggaacgtttacgacctggcttttcggaatatggacttcttcttcatccaatacctcaatcgccctcggtttcgtagggtcccgtctgatcaggccttttgtctccagccgcgccaaatggccgtgcacggttgaactggaagccagtcctactgcttctcctatctctcttacagaaggcggatatcctttcgtttttacctcttctttaataaaacgcaggatatcaagctgcctttttgatagcttcgtcatatttcgcacctcaaaacgtcgattttaagtagattatagcatgattttcctgacagtacaaacataggttcgaaaaaaacgattgacagaaacatttgttcgtatatactgaaagatataaaaagcgaacaaacattcttatcggaggttgtttacatggcgaaagaatctatcatatttgtcgggctgtttactgcgattttaagtgccgctattttacttgtttcatgtgcgggaaatgatcagtccctcagccaatatgttaaaataaaggttcaggacggcgatacactctggtcacttgcagatcatgtagcagaaaagaaacacattaataaagaagatttcattgagtgggtgacggagaataatcatctccagactgctgatataaagcccggagacgaacttattctaccggttaagaagaagcatccggccgtatatcagctggccattgtcaattagagaggaaagagagaaatgaaggcgctcatttatgcccgcgtaagcacaaacaaagaacagcagcaaacgtcattaaaaagacaggaagaggagctcagtgagatcgctgctgcaaacggcatggaagtcgtgaaagtcatttctgagaaagccagcggttacgaaatggaccgcgacggagtatttgaaatgcttgatgaaattaaaaaatcacatattgacgcgatattggtgcaggacgaaacgagattgggaagaggaaacgccaagattgcgcttttgcattgtatttacagggagaacgttaaaatatatacgacggctcataaaggtgaactggagctttccgaagctgattcgatggtacttgaaatcgtcagtattgttgaggaatatcagaggaaaattcacaatatgaaaatccggcggggaatgaaaagagccgtgaaaaacggctacaagcctgaacggaatctgaaaaacagacatgaaaacagcggaaaagaaaaaaaagaggttccggtttcggaaattatcaggctgagagccaacaagcttacctttgcagaaatcgcagcgaccttaagaggattcggctatgacgtgtccaaagccacggttcaccggcggtttcaggaatataccgcagacacagaaggcagctgacgcgcatcagttgtaaaaaagactgcgttttagtagtatataatcaacacgcaccaaaggagcttattatgatttctaaagaaaaaatcgcaagaattaacgaattggctcaaaaagctaaatcaaacacaataacggatgaggaaaaagctgaacagcaaaagcttcgccaggagtatttgaaaggattccgctcctcaatgaaaaatacgttaaagagcgtaaaagtgattgatccggaaggcaacgatgtcacccctgaaaaattaaaaagagaacaacagaaaaataatcttcactaaacagaaagaatacggcaatacgtattcttttttcgtatatactaatatcaggatgtgctttacgacaattttcaacaagtttatctcaaatttaagctgaaagagttgagaaaaagtcagcatcgctttatgatgaaaaggtacaacaataaggaaggggattataatggatacaattgaaaagaaatcagttgccaccattcgtacactatctatagacgcaattgaaaaagcgaattccggacatccgggcatgccgatgggagccgctccgatggcatacacgctgtggacgaaatttatgaatgtaaatccgcagaatccgggctggtttaaccgcgaccgctttgttttatcagcaggccacggttcaatgcttttatacagcatgctgcatttaagcggatatgacctcagcattgaagacttgaaacagttccgtcaatggggaagcaaaacaccgggacatccggagttcgggcatacagccggagtagacgcaacgaccgggccgcttggacaggggattgcaatggcagtgggaatggcaattgcagaacgccatctggctgagacatataaccgtgattcattcaacgtagttgatcattatacatacagtatttgcggagacggcgatttaatggaaggcatttcttccgaagccgcttctcttgcaggccatcttgaattaggccgcctgatcgtattatacgattctaatgacatttccttagacggcgatttagaccgatctttctctgaaaatgtaaagcagcgttttgaagcaatgaactgggaagttctttatgttgaggacggaaacaacatcgctgaattgacggctgcaattgaaaaagcgcgccagaatgataaaaaaccgactttgattgaagtgaaaaccacgatcggtttcggttctccaaaccgtgcgggcacatccggcgttcacggcgctccgttaggactagaagagagcaagctgacaaaagaagcgtatgcttggacgtttgaagaagatttttatgttccggaagaagtatacgggcatttcaatcaagctgtaaaagaagccggctcgaaaaaagaacaggaatggaatgaactgttcgcggcttataaagaaaaatatcctgagcttgctgaacagctgtcactcggcatgaaaggcgagcttcctaaagactgggatcaggaagttcccgtttatgaaaaaggcagcagccttgcttcccgcgcatcttcaggtgaggtactgaacgggatcgccaagaaaattcctttctttgtcgggggatctgctgaccttgcgggttcaaataaaacgacaatcaaaaatggaggagacttcacggccaaagactacgccgggaaaaacttctggttcggtgtccgtgaatttgcgatgggcgctgcattaaacggaatggcgcttcacggcggcctccgcgtattcggcggcacattctttgtattctctgattatttaagacctgccattcgtctggcatcattgatgggactccctgtcacttatgtattcacgcatgacagtattgccgtaggagaagacgggccgactcacgaaccgattgagcagcttgcttctttacgcgcacttcctaacctttctgtgatcagacctgctgacggaaatgaaaccgcagctgcatggaaggttgccgttcaaagccaagatcatccgacagctcttgtattgacacgccaaaacctgccgacgattgatcagcaggctgaagaagcgtatgcgggcgtggaaaaaggggcttataccgtttccaaagcaaaaaccgattcaccggacgcccttcttttagcgacaggctctgaagtcggacttgcgatcgaagctcaagcgaaactggctgaagaaaacattcacgtatctgtagtcagcatgccgagctgggaccgctttgaaaaacaatcggctgagtacaaaaacagcgtgcttcctccgaatgtgacgaaacgtcttgcgatcgaaatgggttcaagcttcggatggggcaaatttaccggtcttgaaggagacgttctcgcaattgaccgtttcggtgcttcagctccgggagaaacaattatgaaagaatacgggtttactgcagaaaacgtagttgaccgcgtgaaaaaacttctaaacaaataacgagacaaaagaggatgagtcaaatcatcctctttttcctgtttatgcgacaaaaatagaaggggcggcgtaacagtaatagacaattctttcttttctccttttgtataatagaaagcaataacgaagcgctgtaaaaggggatgaggaaatggaacgtcattactatacgcacctgataaaggatgagtttgcgaaccactacttcgggcgggaaacggctatgtttgagttgtttcgagactatcattggacagatctgacaccccaggaatatcaaatgacagaaaagcaagttcaatatataacggaaccgattccggtgatacatatgcatcagcggctccagctgcatttaaaccgaatgagttacagccgtttggattccatttaccggcttacactgcccggagaaaagggccgcgccaccttcatgatgaaagacagtttaattgagattgcggcttcgggagattatgaggcggaaacgattttctttgagattctgcgtaaaatcagcccctgttttcttgcaatggatttcaagacacggcgctacgggtggttaaatccggtcagggaaagaaattttgtctaaaaacgaggaaaaagagatgtaaatgttgtataatagcctttggtttagtacactttaaactagacaacatgaaggaggaaataaaatgactttatgggttggcatcctagtgggcgttgtcgcattgctcataggtgttgcactcgggttttttattgctcgtaaatatatgatgagctatttgaaaaagaatccgcctattaatgaacaaatgttacgcatgatgatgatgcaaatgggaatgaaaccttctcaaaagaaaattaatcaaatgatgaaagccatgaataatcaagcgaaataatacgtacagattatgatatagagatacatggttataaaaataaaaaacccggagagggttttttatttttgcgtcatgtttcaccccaactgccggtgtgcagttctttttggtattgtatgagaaggtggtcaagctcctggctgagttctatcgtaatgtttgatgtcattccgtttgtcatgacgattttaagcagctctgcccgttttttttcaatttcatttaatagatgctctctaatcacagggatatatcctttcatacataaatctttcacctgagtcgctattattatatccacatttatactgtttttcaaataagaaggagtataatatctcgatgtcaaattaaattatataagctttttctataaaaagtaatccttctcgggaaagtgttaaaaaaatgaaatgattttgtcataactcgaagggagtgtgtcatcgtgagttttaattactttctgacgtttggggccggatttctgtctttcatttctccatgctgtctgccgttgtaccccgcctttttatcttacataactggtgtcagtatggacgaggtgaaaacagaaaaggtgatgctgcaaaagcgtggcctcgtgcatacactttgttttttgcttggcttctccgtgatttttatcgcattgggatatggaacttcgtttatcggcagtttttttacccaatatcatgaagcgatccgccagtttggcgctatcatgctgattcttttcgggctgattactgccggtgtgtttcagccgaaattcatgatgaaagagcggcgcattcactttaagcgccgtccggaggggtttatcggttcggttctgatcggtcttgcgtttgcagccggctggtcgccgtgcagcgggcctattttaggagccgtgttttcgctggcaaatacaaatccttcttcagcagtgccgtatatgtttttatatgttctcggttttgcgattccttttcttgttctttcattttttattaccagaatgaattggattcgcaagcatcagctgcttatcatgaaaatcggcggcattcttatgattctgatcggagttatgctgttttttaactggatgagctacattctgatcgttctgtcaaatcttttcggaggatttacgggtctgtaacggattaataacttttgaactattatataccctttcgtttttggtacaataagactagttaatgttaaatatgtggaggggaatatgacacgagttttagttgtagatgacgccaagttcatgagggcgaaaatcagagagattctggaaacggcgaattacacagtggccggagaagcggctgacggcgaggaagccctggcagtatatcaaaaaatccgtcccgacctggtgacaatggatattaccatgccggtcaaaaacggtatacaggcgctgcaggatattttagcttttgacccgaaagcccggatcatcatgtgcaccgccatgcggcagcagcggatcgttctggaagcgattgaattaggcgctaaagactttatcgttaaaccgtttgaagcatctaaagtgctggaggccgtaggccgggtaacgggaacgtaaacgtgttctcttttcaaattggttttttttatgtttttggagtatagtatatagtatcaaactccgtgcaagcaaaggaatgataaagatgatgattataatttcatccgttattgcagcggccatggccatttccgtgatgatcgtcaggattaaagcctccgacaagcccgcttcacctaaaaaaataattctcccgccgattttcatgagtacgggagcgcttatgttcctttttccgattttcagagtgacgggcgaagaatttttggaggccattacgctgggcgtgatcttctctatttttctgattaaaacatctaaatttgagattaaaaataatgaaatctatttaaaacggtcaaaagcgtttgtgtttatcctgattggtttgctggttatcagaatcgctatgaaatccattttgagcacgacgattgattacggagctttaagcggaatgttttggattctggctttcggaatgattgttccgtggcgcatcgcgatgtttatgtcttaccgcaaactttcgaatgaactgaagaccgctgatattcagatgaattaaaacctttccgtccgccggaaaggttttttatttgagcagggcctgataaggagtaagatcaatctgtttttcgcggagatgcttttttaaaaattgatgatcacgcttaggagtggccagtatgtaacccctgatgattaaatcacgatttatttgttcagcttcctccgctaaggaaagttcaccgatttttccggcgattttcgctttggctacatcccgaaagagctccggcacgggagcgaccaattcatccaaaaacgccttgtcacccgcattccataagtgcctgcttttttcaatataatagtcctgccaatccagttctgaccggccgtcttctttcggtaagcgttttaaaaattttcggaacataaaaaatccgccgatagacagcaatccgatcatcacgatgacccaaaataaaataaaccacataaaccagccttctagcattgttctatctcctccttactttaaccatattgtaaacgaagacagaatagaagaacacatgaaaaaaagaatagaaaaaatgatagatgtccagtcaattcggttgctagaacatattctatcgtatagtgattctgctatttggccatgggagattcactttgagggtatatgactgatatgaccggacaaaaaagccgcttccattgagggatgaaagcggcttttttatgttatagaggaaattgaaaggaaaatgaggcaggagtctcattaggctccttgttcatggagacggtcagaatatggttggtgaaatcagtgaaaatatgtttgtcattcagataaaaaggaagcaccatttgtttgtttaatgtccgttcaagcgttttaacagagagcataaactcatttcccgaaagagtgacggtgatcgcctgcacctgcttcagggccgtcaggtcggcttcaatgatatactgacggcttgtttcatatagatcgatcggcagcgtctcgtcataccaagcatacgggtcctcgtaaaactgccgcagccattcttccgtatcatcaaattcttcagcgttttttgagtgattcatggaagcattcctccatattaaaaagccttgctataacgtatgcagaagctttaaatgggtgaatggcacaaaaaaacagacaccggggtctgttttacatatcgtggcttgtattatgtttttgtcttgtatggttgcggtttttcacttttttgcttccgctcagcggttccggctggccggggttatggcccttcggagcatttttatgcatatctttactcgtatttttatttgtcatgttaaagcctcctttttaaggtgttccggctattggtttgtttttctttttttattgttctgccgttcttcttccgtcaggacgagctggtcattttctatataacccgcgcctttgccttggcttttcgcatcattcatgccgttaattacatgattggctttccgttttaccatgatcatcacctcaacattaatatggctctttacagcccgttgtatgaggcggaaaatcggacaaaatttaccgaaaatatgctgataagacgatcttattgtatttaataaaaacattgatatttacttatgtatgattttatactaagatgaaattgtgagaaaattgtgatggaatgtgaacattcatctaaagaacgatcttgatcattgaagggggattttggagaatgacaaatcagcaaaaagtcgcaacacaagacgttttccaagcaagaaaaacattttcttcaaatgggaaaacatacaactactattcattaaaagcattggaagacgcaggggtcggcaatgtttcaaaacttccttattctattaaggttcttttggaatccgttttgcgtcaggtagacggacgcgtcattacaaaagagcatgttgaaaatttagcaagatggggtactgctgaattaaaagatatcgatgtgccgtttaaaccgtcacgggttattctgcaggactttaccggcgttccggccgtagttgacctggcatctttaagaaaagccatggcctctgtcggcggagaccctgataaaatcaatcctgaaattccggttgacctggtcattgaccactccgtacaagttgacaaagccggtacggaagatgcgttagccattaatatggacttagaattcgaaagaaatgcagaacgttataaatttttaagctgggcaaagaaagcgtttaacaattatcaggccgttccgcctgcaacaggtatcgttcaccaggtaaaccttgagtttttggcaagcgttgtccatacgaaagaggaagacggagaacttgtgacctatcctgatactttggtgggaactgattcccatacaacaatgattaacggaatcggcgtcctcggctggggtgtcggcggtattgaagcggaagcgggaatgctcggccagccttcatatttccctgttcctgaggtcatcggcgcgaaacttgtcggaaaattgcctaacggaacgacggcgactgacttggcgctgaaagtcactcaagtgctgcgtgaaaaaggcgtagtcaataaatttgttgaattcttcggtcctggtgttgctgagcttccgcttgcggatcgggcgactattgccaatatggcgccggaatacggagcgacttgcggattcttcccggttgacgaggaagcactttcttacctgcgtctgaccggccgtgaagaagagcagatcgatattgtggaagcatactgccgcagcaacggtttattctatacgcctgacgcggaagagccgatttttacagacgttgtggaaattgatctgtcaaaaatcgaagcgaacctttcaggcccgaaacgtccgcaggatttaatcccgctttccgttatgcaggaaacgtttaaaaaacatcttgtcagcccggccggcaaccaaggattcggagcggatgctgctgaagagaacaaagaaatttcatttaaacttaacagcggtgaagatgcggttatgaaaacaggggcgattgcaatcgccgctattacaagctgtacgaatacatcaaacccttatgtattaatcggtgccggattggtagccaaaaaagcggtagaattaggcttgaaagtgccgaattatgtgaagacttcacttgcaccggggtctaaggttgttactggatacttagtcaactcaggtctgcttccttacatgaaggagctcggctttaaccttgtggggtatggctgtacgacatgtatcgggaactccggcccgctttctccagagattgaagaagcggttgctaaaaatgacctcctgatcacttctgtcctgtcgggtaacagaaactttgaaggccggatccacccgcttgtcaaaggaaactaccttgcgtcaccgccgcttgttgtcgcatacgcattggcgggaactgtaaacatcaacctgaaaacggatccgatcggcgtcggaaatgacggacaaaatgtttatttcgatgacatctggccgtccatggatgaaatcaattctctcgtcaaacagactgttacgccggaattattccgcaaagagtatgaaacggtatttgacgacaaccagcgctggaacgaaatcgaaacgacggatgaagcgctgtataagtgggaccaggattccacttacattcaaaacccgccattctttgaggaaatgtctgtagagccgggaaaagttgagcctttaagaggacttcgcgttgtcggcaaattcggcgattccgtgacgactgaccatatttctccggccggagcgatcggaaaagacacaccggcgggcaaatacctgcaggaaaaaggcgtttctcctcgtgactttaactcttacggctcacgccgcggaaaccatgaagtcatgatgagaggaacattcgccaatatccgcattaaaaaccaaatcgcaccgggtacagaaggcggctacacaacacattggcctaccggggaagtgacatctatttatgatgcctgcatgcggtataaagaagataaaacgggtcttgtcgtcctggccggaaaagattacggaatgggctcttcacgtgactgggctgcaaaaggaacaaacctgctcggcatcagaacagtcattgccgaaagctttgaaagaattcacagaagcaacctcgtcttcatgggtgtgctgccgctccagttcaaacagggcgaaaacgcggatacactcggcttaaccggtaaggaagtcatcgaggtggatgttgatgaatctgtacgtccgcgcgacttgctgactgtcagagcaatcagtgaagacggtacggtaaaaacgtttgaagtcgttgtccgttttgacagtgaagtggaaattgattactatcgccacggcggcattttacaaatggtgcttcgcgataaaatgaaacagtagcagaatgaacaaaagagagaaagcagtctgctttctctctttttatgcgggaggcttaagatgcttgcgaaatggctgggcggaatgttacttatcgggttgttagtatatgcgggctggaacatttattccgtgcaaaaaagtccgaaagaagggacagaagaagggatgaaagcccctgactttacacttgatacattgtcaggaaaaagtatctccctatctgattataaaggaaaaaaagtgctcctcaatttctgggcgacgtggtgcaagccgtgccgaatggaaatgccggatatgcaggagctgcagaaagaatatcctgatattgcggtagcagccgttaattttacgtcttctgaaaaaaatatacaggctgtgaaatcatttgctgatcattatcagctgacctttcctattctgattgacaaaagcggaattaacggggatttcaacgtgctttcttatccgacaacatacatattagacgaaaaaggaaccattcagcacattcgcgtaggcacgatgacaaaaaaagaaatgaaagaaaaactggatctcaaatagaggttcagtttttttattgtgaagggcttaggttttgaaaaattggaaaaaatgaatgaaaacacggaggtgagaagattgaaaaaaatgcgaaaacgttcttttcatgaattggttatggaaaataaacgtgagctgatgaccaatacggaatatttgaatcagcttgaagaaaagctggagcagcggttcaaacaaaaataacctttaatttgcagtcatgtttgcacctccttttgcaaaatatactcttaaggagggatgaacatgggcataaacaagaaagacggccagccgcaatacgctccgagccacttagggacaaaacccgttaaatataaacgcaacaaaggggaaaagtttcatgacaagtcaaacggacatccgattgtcatgcagacgaaaggcgaataacatcatcaaaggagagcagacattatgacaaacaatgatcaaaaaccgaatccggatgaccgttccgataacgttgaaaagctgcaggatatggtgcagaatacaattgaaaatatagaagaagcgaaagaatcaatggaatttgcgacagatgaggaaaaacagcgcattcaagaaaagaatgccagacgcaatgaaagcattgaatcgttccgcagtgaaattcaggatgaatcggctgcaagagaaaacggctatcaatcataataaaaaccagggaaacctggtttttttctctttccggctcgttgtgataaaatggggctaatctgataaaaagggagcagagaacgttgcatgtgtcaaaaaaagaaatagaagtgcgttatgcggaaacagatcaaatgggcatcgtctatcatgccaattacttagtctggatggaggtcggcagaacggcgctgattaaggaactcggattcctttacaaggatatggaagatagaggagtgctgtcccctgtattggatatcagcatttcttataaaaagccgctccgctacggtgaaacggctgtcgtacatacttggattgaagaatataacggatttaaaaccgtttacggctaccacatctataatccggatcaagaacttgccatcaaagcgacatcctctcatatatgcgttgataaagagagcttcaaaccgattcagtttcgcaaggcttttcctgattggcatgccgcttacgaaaaggcaaaaaaataaggagcggctgcacttatggcatttggaattacgcgtaaggaactggaaagatggaagcaggatgtatcggaagggaaaatcgcttttttaacgcattactggctggacgaccgctttccggaggctaagaccgtgacgaaggccggttcaagcgatctcaataaactgatcagatggggagcggagtacgggctgaagccggagtggattcaccataaaaatgaatttccccactttgacctgctcggagaaacgcaaagaagcatattagaaaaagaacgtctgactgatcacctaaaaaggttcaggctgtaaaaaaaagaacgcatccgctgcgttcttttttttacacgtaatcaaataccggctcttctgcctgatctgaatatgtgactgacaaatcgtgattatcaaagtaccataagtcgctttcttcaataaaaaaggtaatgccttcaacttccgtgctggtgccgatgttcatcggcaggtcttttaaaatgccgagagaaaagcctttctgaacgttgctgcatcccccgtaacggacaaagaaacggacatggtcgcctgtttccagatcgagctcttctttgtaccaatccagcgcgcctttcgttactttcatgttcatccggaacactccctttttgtttctcatataaagaaattatctctattataaacgcatatggcattttgatgtcaaaattgaagtttcatcaaaaccatttgatcttcggttctgttttgtttataatccgtttgatgtttgccctgtgtctgtagataacaaacgcggtcaagagcgtcactacgattaataaataagggtcttttacaaacagacagtaaataatcgtataaatccctgttaacattgaagacagagaaacaaatttcgtaaggaataaaaatacgaaaaatactgcaaccatcgtaacgaataacagcggagcataaaacagcaggacgccccctgatgtggctacggctttgcctcccttaaactttgcgaacacggggaatacatggccgatcactgctgccacccctgcgagaagaggatgaatggggacgtgcagtaaatatgggagcgccgcggccagggtgccttttaaaatatcggctgcgacgacgacagatcccgctttaacgccaagcgtgcgaaaagcatttgtagcgcccaaattgccgcttccgtgttctctaatatcgatccctttcgcaagtttgcctacgactaaacctgacgggatgctgcctattgcataggccaaaataatcaataaagcaatcaacatctacatttctccttttcaatgtcccttcactctattttaacacgagttgttaccgtctgatgacaagttttttgagaattaagctgacaaatcgctttttttgattccggcgaagcggtcatgtacaatatatcaaaaggagatggtaaagatgcaaaatccttcaaaatcagagattaaagaaattctggaccggagcaaacggatcgcggtcgtcgggctgtcagatcgtcccgaccggacttcttacatggtttccaaagcgatgcaggatgaagggtatgaaattattcccgtcaacccaacgattgatgaggcgcttggcgttaaagccgttgcttcattaaaagacgtggagggaccgattgatatcgtgaatgtgttcagacgctctgagcagcttcccggcgttgctgaagaatttttacagacggacgctcccgttttttgggcgcagcagggccttgcaaatgaagaagcgtatcgcatgattacagacaaaggacggacggctgtaatggatttatgtataaaagtcgcccgcgctgttataaaataggaacaaaaaaggcaaaaatccttggcaaatcaggggtttttgcttttttattgaaagaatactctttgcgtatgatgatgaaacagatacaataaagcatgaacagcttttttagaaacccctttatacaggggtttgcagtctgtttgcgatggccggcataaagctatataatagaaagcgaactcatgttcttatctgccgaaaagggcaccaaaaagatgaaaagccgttcgaatgtatgtcttgcggcctaaaaaacgagccattcgcttaaatatgttgcgaaatcaagcatattggttataattgtgagtccgaggagaattggaccgaagcttgcgcatactgaaaaacaaagacatgaaaacatttaaaaaagagaatgattaagagcaggttttttgaaaggggtttgtacgtttggctagaaaacagcaatttgattacaacgaagatgccatacaggtgcttgaaggcctggaagccgtcagaaaacgaccgggaatgtacatcggttcgacggacgcacgcggcctgcaccatctggtatatgagatcgtcgacaattccgtcgatgaagttcttgccggctacggagatcatattatcgtaacgatacataaggacaacagcatctccgttcaggatagaggacgcggaatgccgaccgggatgcataagctcggaaagccgacgccggaagttattttcaccgtgctgcatgccggggggaaattcggacagggcggctataaaacaagcggcggtctgcatggtgtcggcgcatctgtcgtaaacgcattatcggagtggctgacagttactattgagcgtgacggatatgtctataaacagcggtttgaaaacggcggcaagcccgtgacttcacttgaaaaaatcggaacgaccaaaaaaacgggaacgcttacccattttaaacctgatccgtcaatgttcagctcaacggtttataattttgacacgctgtcagaacgtctgcgcgaatcggctttcttgttaaaaggtttgaaaatagaattaattgatgaacggaaaggcgtaaaagaagtattttattatgagaacggaattgaagcatttgtcgcttatttaaacgaggaaaaagacgctttatgcgaagtggtgtcctttgaaggcgagcatcatgacattgaagtcgatttcgcgtttcagtttaatgacgggtattcagaaaatatgctgtcattcgttaataacgtcagaacaaaggacggcggcacccacgaatcaggagccaaaacggcaatgacaagagcgtttaacgagtatgcgcgaaaggtcgcccttttaaaagagaaagacaagaaccttgaaggcgccgatatcagggaaggtttgtccgcaatcatttccgtccgtatcccggaggaactgctgcaatttgaaggccagacgaaagggaagctcggcacaagtgaggcgagatccgccgcggatgccgtcatttctgagaatcttgcttatttcttggaagaaaaccgcgatacggcaaccctgcttgtcaaaaaagcgattaaagcaagccaggcccgtgaagcggcccgtaaagcgagagaagaagcgagaagcggcaaaaagcgcaaaaaatcagaagcgacgctgagcggaaaactcacaccggccggttccagaaatccggcgaagaatgaattgtatctggtggagggagactctgctggaggctctgcaaaacagggaagagaccggaaattccaagccgtgctgccccttcgcggaaaggtcatcaacacagagaaagcaaagcttgcagacatcttcaaaaatgaagaaatcaatacgattattcatgcgatcggcggcggtgtcggcgcagattttgatatagaggacatcaactatgacaagatcatcatcatgacggacgcggataccgacggcgcgcacattcaagtcttgctgttaacgtttttctaccgctatatgaaacctttaatcgagcacggaaaagttttcatcgcccttccgcctctttacaaagtgagcaaaggaagcggcaagaaagagattattgaatatgcttggtccgacgaagaaatggacggcgttttaaagaaagtcggcaaaggatataccatccagcgctataaaggtctgggagaaatgaacgcagaccagctctgggaaacgacgatgaatcccgaatcgcgaacgctcgtcagagtcaagatcgacgatgcggcacgggtagagcgccgtgtaacgacattaatgggagacaaagtagaaccgagaagaaaatggattgaaaagaatgttgccttcggattagatgaggaaagcaatattttggaaaatgaaaacttgtcggtcgctgaggaggtttaatagtggcacagccagaattatttcatgatttaccgttagaagaagtaatcggcgaccgtttcggacgctacagtaaatacattattcaagacagggcgctgcccgacgctcgtgacggtttaaagccggtgcagcggagaattttatacgccatgcacgcagacggaaatacattcgataaaaatttccgtaaagcggcaaaaacggtcggaaacgttatcggtaattatcatccgcacggtgacagctccgtttatgaagcgatggtgcggatgagccaggattggaaagtgcggaatgtgctgattgagatgcacggcaataacggaagcattgacggtgatccgccggctgccatgcgttatacggaagcgagattatcttctatcgcgtcagagcttttgcgtgatattgataaaaatacggttgaattcgttccgaactttgatgacaccagtaaagagccggttgttttgcccgccatgttccctaacttgcttgttaacggatcaaccgggatttcagcgggctatgcgactgatattccccctcatcatctgggtgaggtcattgatgccgtcattaaacggattgaatctccggattgcactgtcgatgacttgatgcaggtgattaaagggcctgactttccgacaggaggcattattcaaggagtcgacggcattcggaaggcttatgaaaccggtaaaggcaaaattattatccgcggcaaggctgaagtggaatccgtaagaggcggacgggagcagatcgtcattacagaaattccgtttgaagtaaacaaagccaatctcgttaagaaaatggacgaataccgcatagacaaaaaagtcgaaggcatttctgaagtcagggatgaaactgaccgcacggggcttcgggtggtcgttgagttaaagaaagaagccgatgcaaaaggcatcctgaatttcttatataaaaacactgatctgcagacaacatataactttaatatggtcgccatacataaccgccggccgatgctgatgagtcttacggccatcctggatgcgtatatttcccatcagaaggaagtggtgacaaaccgctccgtctttgaattacaaaaagcaaaagagcggcatcacatcgttgaaggactgatgaaggcactgtccgtgttagatgaggtcatagcggtcatccgggcaagcagcgacaagaaagatgcgaaacaaaacttaatttctaaattcgcatttacggagccgcaggccgaagcgatcgtatccttgcagctgtatcgtctgacaaacacggatattacggcgctaaaagaggaagcggaagagctcagcaagaaaattcaggagctcgaagccattttaagtcatgataaaaagctgttaaaagtcattacaagcagcctgaaaaaattgaaaaagacctatgctgacagcagacggtctgtcattgaagaaaagatagaggaaattaaaatcaatcttgaagtcatggttgcctctgaggacgtatatgtgacagtcacaaaagacggctatgtaaaacgaacaagccagcggtcatttgccgcttctaacggccaggatttcggtatgaaggatactgacaggctgattcaccaatttgaaatgaatacaacggatgttcttctgctctttaccaataagggaagctatgtttattgtccggttcaccagcttcccgatatcaggtggaaagacatggggcagcacgtaacgaacatcatcacgattgaccgtgatgaaaccatcgtgaaagctataccggtaaaagaatttgatccatcttcatatttactgttcatgacgaaaaacggtatggtgaagagaactgaaatgacgcattacaaagcgcagcgttactcgaaagcgcttgttgcccttaaccttaaaggggatgatgagctgattgatgttcatgtcacagacggcggcagccagctgtttatcgccacccgcctcgggtacggtttatggttcggtgaagatgaagtaaatgtagtcggtgcccgtgcggccggcgtaaagggcataaatttaaaagacggtgataccgtcgtatcagggcaaatcctgcatgaaacagattcgcttgtcctcgtcacacagcggggagcaatcaaacggatgaacctatctgaattcgaaaaaacatccagggcgaaacgcggtgtcatcatgctgcgtgagctaaaaaagaacccgcatcgggcagtcggcgtatttgcgtgcgctttggccgacatgatcgctgcggaaacagaaaaaggcgagagaatcgaaatcgccgtgaagtccttgcgggcgaatgaccgatacagcaacggctccttctttaccgatgaagatgagacagggccggtaacagatgtatggcgtatccctgcatacgatgtttaagagtaaaaataaaataaaaaacctccgctcattgagcggaggttttactatttagctttcatggctgccgaataagtcagtgatagcgtgaatgacttcgattccctgccatacaaataaattcaatgcagtgaatgaaaacaaccctaaaatcaccattcgtaagataaacaacatgtttaacaacctcctcattttatgttacatagataggcgatgttgaacatgaagctcatcgaaatacgaggactgataaaatttagcgattaaaaagcttttctttcgctgtcttctccgggaagcggggcgtctcctgtctgatatcacaatcagtgagacagaagcggcaaaaagcgccgtcaagatatatgagcccgtcagcgattttttctcatcatcagcattttggccggccttcatttcgtgcatttcctgctggtcggctaccgctttaaaatgatgagcggtatcaaacgcatggggaatggagagcaaatgaaagcttgcaatcgctaaaaataaaatagaagcttttaaaaacaagatttttttcaaatgttctcctcccttcataagtctgaatatttttattataataccctaatttaaatgtaaagtaaacacatttattaaatttaaaaaattattatcctggttaagtatataccattccatccatcttttcatctcttttttcttaaagacctatttgttatgatatgcacgcattccttataacgtgacaacatttttcaggctgtaagataaaaaacggggcatgacagcaaaagatgtgatgaagaaaccgaaacattttcttaaaaaaacttctcaaccactgttgttgtgatataataatacccgttgtgttaaaagatctaacatatacagcaaaaatgacagtaaaagatatgtaaaagggaggttaaacatggaggctttcatcagtgaaatcataaatgttccaaatgattttatttggaagtatcttgtttatattttagtcgggatcggattgtactttacgttccgttttcgctttattcaattccagtacttttttgaaatgttcagaatcgtcggggagaagccgcaaggaaataaaggagtgtcttcaatgcaggcattctttatctcagcagcttctcgtgtcggaaccggaaacttgaccggcgtcgcgctggcgattgcaacaggcggtcccggcgcagtattttggatgtggatcgtagcgattgtcggtatggcttccagctttgtggaaagcaccttggcacagctgtataaagtgcgttccggtgacgaattccgcggcggtccggcatattacatggcaaagggactgggcgcccgctggctcggtattttattcgccgtattgattaccgtttctttcggacttatatttaacgcggtgcagtcaaatacgatttctgtggcgtttgacgaagcattccatgtgaataaaacagttatcgcaatcattttagctgtattaacggctttcattatattcggcggtctgaagcgtgttgtttccgtctcgcaattaatcgttccggttatggcgggaatgtatattctgatcgcgctgtatgtcgtgattgtaaatatttcggcggtacctgagctgcttgttacgattgtgaaaaatgcgttcggtcttgagcagatcgtcggcggaagcttaggaagcatcattattatcggagcgcagcgcggcctgttttcaaacgaagcgggaatgggaagcgcgccgaatgccgcagcagctgcacatgtgtcgcatccggctaagcagggattaattcagaccctcggcgtgttctttgatacgtttatcgtttgtacatcgactgcttttatcattttattgtacagcgttacgcctaaaggcgacggcatccaagtgacgcaagccgcactgcagcaccatctcggcggatgggcgccgacatttattgcgattgcgatgtttttattcgcattcagctcagtcgtcggcaactattactatggtgaaacgaatattgaatttattaaaacaagcaaaacatggcttaatatttaccgcgtattcgtcgtagtgatggtggtatacggatgtttggctgacttccagatcgtctgggacatggcaaacttgtttatgggtctcttggctctcattaacttagtggcaattttactgctgagtaatgtagcctacaagatctataaggattatgccgctcagcgcaaaaaaggtcttgatcccgtattcaaagccgagaatactccggagctcaagcatattgaaacatgggcggaagaagaaggtacaagccctgaacgtaagactgctaactgaggaaacatgcatacaattttcaaaaaacccccttacattttgttgtgaggggttttttatgtgaaaaaccgggttatttttactggaaacagatttttttgaatttattgtatttttctcttgtatatgtaagtgctttcatataaagtttaactaaaccggtttaccaaaccgatttagtcttaaaggaaaggagtattgatgtggcttctgattatggcatttttacgatcggtgatgcgatgatcaccttaaatcccgcaagcacaggacctttgcgttttgttacccattttgaacgaaaagcaggaggagctgaactgaattttgcgattgcatgcgccagattgaacctgcactcaaagtgggtcagcagactggggaaggatgagttcggcagagtgatttatcagtttgccaaaggagaaggaattgatgtgactgacgtctcctttgttgaaggctttcctacatctttaaatgtcaaagagatcagaaatgacggttcaggcaagacgttttattatcgtttcaattcaccaattctgactcttgcaccggaagatataactgagaatatgtttgacggcattcacatcgttcatcttaccggtgtgttcctcgcgcttggtaagaaaaatcttgaaattgctgaaagggtgctttccatcgccaaagcaagaaagattcccgtatcttttgatccgaatatcaggctgaagctgtggacgattgaggaggcacgtgcggcatttcatcaaatctttccgcatactgatattcttctggcgggccgggacgaaatgaaacagctgacaggtataggagaaaatgaagcattagcccggtttgcagagagctattcaatcagtcagcttgtcataaaagacggtgaagcgggttctgcgctgtatcatgatcataagtgggttcacaaagaggctttcccggttgcgcctgtcgacacggtaggagcgggtgacggctttaatgccggctacctgtacagttatctacatggttttgaaccggaaaaacgtctggagtttgcaaatgcagtcggtgcgctcgtcaccacagtttccggtgacaatgaagggcttccctgcctagaagaggttctgtcatttgtaaacaaagagactgtgattgaacggtagcaagcacaacttaaaaagcgggtgaaaaaatgaaagcggttcaagtacggaaagcatttgatctgatggtgacggaatgtgagaaaccgtctgttgtccacgcggatgatgttcttgtcaaggtgaatcgggtcggaatttgcggatcagatttgcatatttatcatgggacaaatccgttagcgtccctgccgagagtaatcggacatgaagtcacaggggaagtcgcaaagaccggttctcatgtccggcgtttcaagccgggtgaccgggtagtgattgaaccgatatcttattgcggaacatgctatgcctgccggaaaggacgtccgaacgtctgcaaagcgctttcggtgttcggcgttcatgaagatggcgggatgcgggaatatatcgtgcttccggaaaagcagctgtatgctgtttcgcccgatctaccctgggaggaagcggtcatggcagaaccatatacgatcggcgcccaggccgtttggagaggccgtgtcgagaaggaagataccgttttgattcaaggagcggggccgatcggaatctgcatattaaaaatggcaaagttcaaaggcgcttccgtcatgataaccgacttgaatgatgaacgcttggccttcgctgaaaaaaacggtgcggatgttaccgtcaacgcgcaaaaagaagatcccgttttgcgggtgaacgaatggacaaaaaatgaaggcgctaatgtcgtcattgatgccgtctgtctcccctcaacgtttgaaacgtcaattgacgcagtgtctccggccggtcatgtggttgtgcttggttttgatgagaggactgccggcatttctcagcttccgatcacaaaaaaggaagtcacgatcaccggttcaagattgcagacgaatcagtttccgtacattacagacttactgaataaaggcctgttaacgcacggcggtcttattacacatacattttcagcagatgacgtccatcgagcatttcagttgatcgaacagcacccgggcaaggtgggaaaagcaatcattacgtttgattaaaggaggagcgagaatgctgcctaagtacgccatttacgaaaaacttctgcatgcacaagtggtggctgtcataaggggacaaaacagccaagaggcgcttgaagtttcaaaagcggccatttcaggaggtatcagcgccattgagcttacatacacaactcctgaagtggaagatgtctttaaggaactccggcatcaagatattcttcttggagccggttctgtaatggataccgaaacagcgagacacgccattttatcaggcgcctcatttatcgtcagctctcattttgtaaaagagatagcatctctatgcaaccagtacagcgtaccgtatcttccgggatgcatgagcgtgtctgatatggctttggcgctcgaagccggatgtgatgtggtaaagctgttccccgctaattcgtttaatccctcatttatcaagtcggtcaacggccctctgccgaatgtccgcattatgccgaccgggggtatctcattaaacagcatgaatgactggctttctgccggagcggtcgcggtcggagtgggaagcgacttgacaaaagcatatcaaaagggcggctatgaagctgccgtatccctcagcaaagaatacgtctgccgaaaaaacgaatatacgggggtgtaacatgaatatcacgtttcgctggtacggccaaggtaatgatacggtgacgcttgaacatgtcagacaaattcccggggtcaaaggcatcgtctgggctcttcaccagaagcccgcgggcgaagtatgggaaaaggaggacattgaagccgaagtcagattcattcaatcctatgggtttcatgcagaggtcgtggaaagcgtgaatgttcatgaagccattaaactcggccatgaagaacgcggacaatatattgagcactataaacagaccattcgcaatctgtccgaattcggcgtgaaagtcatctgttacaatttcatgccgatttttgactggacgcgtactgatatgttccgcgcactggaggatgggtcaactgctttgttttttgaaaaagcgaaagtggaaagtctccctccagaagaactgatccgcacggttgaagaatcttctgatttgacgcttcccgggtgggagccggagaaaatggcccggatcaaggaactgtttgaagcctatcaaacggtcggtgaaaaacagctttgggccaatctagaattctttttacatgaaatccttcctgtagcggaggaacacggcattcaaatggccattcatccggatgatccgccttggtcaatttttggcctgccccgtattatcaccggtgagaaaagttatgaaaagctgcgagagatttcagattcacccgccaactgtattacgttgtgcacgggttcgatgggagcggatcccgccaatgatatggtgaagatcgccaaacactatgcgggagctgcgccgtttgcccatatacgaaatgtgaaaatctgcgataacggtgattttacggaaacttcgcatcttaccagtgatgggtccattgatattatcggtgtggtaaaagaattgcacggccaaggctacaaaggatatgtacggcctgatcacggccgtcatatctggggcgaacaatgccggccgggctatggtttatatgatcgtgccttaggaattatgtacttgagcggactgtgggatgcgttctcgtctcatgagaaagaggtgaagagatgagaccgattcatggacgtttatcaggaagaaccgctgtcataacaggcgggagcggtgttctctgttcagcaatggcaaaggagctttcacggcaggggatgaaaattgcgatcgtcagccggaatgctgataaagcagagcgtgcggcgggcgagattgctgatgctggaggaaccgcggtttctgtaccggctgatgtttcagcccgtgattcgctcgaaaaggcaaaagacgagattatcagccggttcggctctgtcaatcttttaattaacggagccgggggaaaccacgctgatgcgatcactgccaatgagacgtatgaagaggatgagcagagcccatcattttttgatatggacgaaacgggattttccagcgtattttcaagcaactttaccggtgcatttctggcatcgcaagtgtttggaaaagaccttttgaaggcggaatgtcccgcgattattaatatttcttctatgagtgcgtatacaccgatgacaaaggtgcctgcctacagtgcggctaaggcggcggttcagaattttacgatgtggatggctgttcatttcgcgaaaaaagggctgcgggtgaatgccatcgctccgggtttctttttgactgcgcaaaaccgtgagttgttattacaggaagatggaagtctgacagaccgatccaataagattatggcacatacaccgatgaaacgtttcgggaaaccggaagaccttctgggaacgctcctgtggctttcggatgattcatactcaggctttatcaccggggtcaccgttcccgtcgacggaggttttatggcttattcgggagtgtgacagaatccagttccctgtcagattgtaaactatttacttctgacttatactagtgaaaaatgaagacagacggggatgagtctatgaaaaccattacaatttctgatgtggcgaaatatgcaaacgtatctaaaagcaccgtatctcaatttttaaatcagcgctatgactatatgagcgagaaaacgaaacaaaaaatagaagcggccattcatgagctgaactatcagccgaatttcgtcgcccgcagcttaaaacagaaatcaacatttacggtaggtgtggtggtggctaatattcttcacaccttttccactcaggtcatcagggcggtggaagactattttcatgaacaaggatttcatattattgtctgcaatgcggatgatgaaccggaaaaagaaaagaaatatattgaaatgctcagggccaagcaggtggacggaattattatttttccgacgggcgaaaatctctccttatatgaaaagatgaaacgcgatacgtttccggtcgtgtttatggacagaaccattgaagaactcgggattccgacagtgatgcttgataaccatcatgcagccggtcttgccgttgaccggtttatcgagagcggcattaagagaatcgcgattattacgacgtccattattcgggaaatcagtccgagggtagagcggattgaagggtataaaaaggcgcttgacccccacgggatgatggtgcggaacgaatatatcaaaacagccgatgcggctgatatttccaatgttttgtcagagctgttctcacttcaggagcctccgaaagcgatattggcggcaaacgatatcgttcttgttgaggtgctgaagtatatgaaggagcatgatatgacaatcccggataaggcagccgtcatcggaattgatgaagttccttttgcgggtttttttactcctccgattacgacgatcgtccagcctgcggcagaaatggcgcgaaaagcgggaagccttcttctttgccagatacaagaaaaagatagcggtgaaaaacggattcaccgctataaaccggcgcttctggcaaggcaatccggataaccggtttcattacataaaccggtttactccggcaatttaaattatgaaataagagggagggattttatgttctcaaaggatagattccctattcttcttcttttattttcagccggggtgattaactatttagaccgttcagcgctgtctattgcggcgccgttcatacagcaggatctcacattgtctgcaacccaaatggggctgattttcagcagtttttctgtcggatacgctgtgtgtaacttccttggcggtgttgcatctgaccggtacggggctaaattgacattgtgtacggcgatgatcgtttggtctcttttcagcggggcggttgcgcttgctttcggatttgtaagtcttttgattatccgtgttttattcggtatgggcgaggggccgctgtcggctgccataagcaaaatggtcaacaattggtttcctccgtctcagcgcgccacggtcatcggcctgacaaacagcggcacgccgctcggcggagcgatttccggcccgattgtcgggatgattgctgtggcattcagctggaaggtttcctttgtcctgatcatgatcgtcggtttagtctgggcgtttatctggtttaaatttgtcaaagaacggccggcacagacggaagacaccccggcaatgaaagcggcggttcaatcgcatgagcagcatatcccgatgaccttttatttaaaacaaaaaacggttctcttcacggcttttgcctttttcgcctacaattacatcttatttttcttcttaacatggtttccgagctatctggtgaaagaacgcggattaagtattgaatttatgagcgtggtgactgttattccctggattcttggatttatcggtttggcggcaggcggaatgatttctgattatgtatacaaaaaaaccgccggaaaaggggttttgttctcacggaaagtcattcttgtcacttgcctgttcgcttccgctgtactgatcggatttgccggacttgttaccactgccgtaagtgccgttattctcgttgctttatcagtcttctttttatatataacgggctctatctattgggcggtgattcacgatgtggttgatcaaaggaatgtcgggtcagtcggcggctttatgcattttcttgcaaacacggccggtattatcgggcctgctttaaccggctttatcgcggataaaagcggatcattctcgggggcgtttttgcttgcaggcggattagctgttttggcctcggctgcggtaatccgttttgtgcgtccgattatcattcaaacagtttctgaagataaaaaagacacgataccttattcataagtcatcaaagccactgaggctgtcctgccgataacgggatggccttttcgttctcccgcttgatctgttcctatgataatataggaattgtttacaaaagaagggaagaggagggagcatgaaacagaagccgatatatgtcgaaatcaatattgcatctgatatagaaacgctttgggaatatacgcaaaacccgcatcttcataaagaatgggatctgcgtttttctgacattacatatcttcataggctgccagatgaaccgcagagatttctatatgaaacacgaatcggttttgggctgaaggtatccggcacgggcgaatcaataggtgacataaggcctcgcttgtcagaaagagtgtcttcgctcgcttttgcctctgatcatccgctgtcacttataaaagaaggcaggggctactggaagtatacagagcgggataacggacaaacctcatttttgactcaatatcaatatgaaacggcccgcggtctgccgggaagttggatagaccggtttttatttcgtcctctgctaagctgggctaccgcatggagctttgatgcgttgcggctttggatagaacaaaacagacatccgaagatatcggtccgtttcggatttgtctatgtctgtatgtgcctcgtattcagtctgtattggttttttcaaggctttcatgatggctgtgccgatgcagagatcgtgaggggaacgctggagacagggttaggggtattatggctgcttcccatgcggagaaagtggctgattcacgccgggcagtcagtcttcttttgtgtaacggcactgttatattccggcggcggattcttgatttcattaggagtccttacgatagccggcatgattcttaagctcaagctgccgagcgcctggcatacaaaacgaaagagagaagtgaaatgacggattcaatgtatgaaaaaacgattactcattatcaatcactgcacccgatgctgcagaaacggtacagatttgacggatcacgcacgttttgcggagaaggcgttatgtcagaaataaagggaggttcttttcttgtcagaatgcttttaaagaccggtgtttttttcagatgttttttctcagagaggggaaacgatatcccttttactatcgaaaacaaaaacaggcaaaatggcgtggaatggaatcgtacctttttctttaaaggcaaaacgcgtttttttgatgcggtcatggaatatgatgagcgggaaaacagaattcttgattacttcggcaaacctcacatcctactgtctgaactgcatttagaagcgtcttcagacggagggcttgttattacatccggaaggcagtggctcctgataggcggaaagaaaatcccgattccggcatggctgtgcgggaattcaaccgtttatgaggcttatgatgaggaaatgaattgcttcagcataaaggttcatgtgaaaaaccggatactcggcacgcttttctcttaccgggggactttccgggaaacagagggagaaacatgctgaagcgtcatctcatggtaagcgtggtttgctttttgggatttgcggcggctgaagctccgcatatatcagctgctgagacgtttgttttattttccgtgctttttttcgttcccgctgtattctgctttgcttttcggccgtcaaagaccttagagaatgtgtggttacggagttatcctgttgccgctatatgtgcggcgcttgcgcttgtcacaggcttcagcttttttgcctttgtgtggttcatttatacgcttggactggcactgtatgctgtccgccggctgatgaaaacaaatattcacagaacagaagagatgtcagttatggcgggtttcatttatttggccgggggcggattctggttcttcgcatatgtccttgagattcccgtcctgaatttcggcccgcttatcgttctgctgacggcggtgcactttcactattccgcttttctcattccgatctttaacggattgctcggcaggatcatacgggagaaacgcggactttaccggtggagcacagtcattattttgatttcgccggtcctaattgccttggggattacattttcaaagacacttgatgtgattgctgtcgctctgtatcttgcgggtctgtatgtaaatgcatatctcgtctttaaggcgccgtttgttacgaaaacaggcaggatcttgatcaggagttcttcggctgtgttaatgatcacaattgctttttctttgatatattcgtacggtgtctaccgcgaggaggcaacgctcacgatcagccagatgatttggattcacggggccgtcaatgcatttggcgttatcctgccggctttggcggggtggagaatagaaaatcctagaccgttcgatgagaacagtgaaagaacgttcagcagaatttacgggaagggaacgataggcaaagattttttgactgacattcatgcagcaaatgacatccattataccggccttcaggatcagctgagagaactgcattctgaagacttttcaactgaaaagctggcgccggccgttatttccttttatgaaaagacaattgattatgacatcatggcgaaagtgacgtggagcggttggtttcgtccgttcgcgcgcgtgtacgagccgttcagcagaagagcgggacagattcatctgtccatgaatccggattggtatatcatgcacagtgatattataggagttgactctgataaagacggcagaaaaaatgtccgtgcatggatcagaacaaatgaaaagcaggaaaccgtttttactgcgctgtattcagcatacaggtcaaaaggggaaggatacatgaatatctctcttcctctgccgtacggccaaatgacgggcattttaaagccttatgcgcgtaagcagaatcttgttttgacaagcagacggcgaaaaagcggagcgggtgatgaagggatttatctccagacgaaatgggggacgtgtcatcttccgctggcagagacatttcttatttcagcccagagcgaaacaagcctgaaggccgttcatcatatgtggctgttcggactgaaatttttaactgtgcattatcggatcactcatgcttccgcaggtaaccgaagcaaataataagctgcagagccgtctgtttatcaggcggctttttctcattatatgaatagataggaagaagataatgcacccggaagtcaattcatattagaggatgtgatgcgttacgaaagacaaggtgctttttctcattgtcacgtttatcttatggagaaagttttttgtcgttttggaccgggagcggcctcggtcttgcggtctttgcctgtctctcacgattcgtgaaatgaaaacggctgcaaagattcctacattgagcggtatgatgaaggcagccgggcagatggccctgctgaaaatcttgttctttttgtttatgattacgcggaaaaaagcagggaagatgcggcaaagtattatcagacctgattttttatatgcttgcctaaagaaatgatctcattgcgggtaatgaccaaacaagaaattcatttcaagcttgcttttgcgttaggtttttcagctgaatcaaaactagcgctgtaaacatttattgcagttataaatttctcttctttgtctcaataactaaagtatacttggtttatgagacttgtaattcatttctctgtataacttcctagaatatatattatgtaaactagaaattgtgaagagaatatataagtgggtccatattctaacagcatcccctttttgtaaggtaatattaaaaaacctctacgtaaaatcctttgatacattaaacgggcgcccatctttacgcttatacatcgtgctattctgatggccgatgcttaccaccacatatcccacgcttgccaagtctgtacagatcactgtgccccattctggagaaccgcccccgccgcaaacatagaataacaccggatagcgtttttccttcccggagagagcaaggccgtcgtaacattgggtcttgatatctatagagtaagcattcttccgcgcagtgagaagcggctgctcatcaagcatttcgcagacttcaggaaacatgtacgttgatgtagtcttcccttcgctgctgtcggacggatagtacacaaacaccgtcagttctctttttgtatgatctgatgccgtgtactcaaaatccagttgtgtgcggccgacagtatagccgccggttggctctggaaatgcgtcataccttttcattctcttgttcccccttaagtaataaaagtggcgggtgtaaaatacatacattgcgctataaacgcttttcaaaactgtgaaacgattacattatatgtacagtcatatctacttcttcacgtaaacctccatgtattgctgtttaagatgataaaagcggacatcgttgctgatgtccgcctaaagcttaactaattgggttctgttccccaaatcagttttccttgatgatataatgtgatttttttcgttgttttaaatgtatttgattggaaaaaggaataatcgtcgctttgtgcataattactccagtcatcattgtgaagacgaagctgaatattccctgtgcttgctcccggtgacagcgttcctgttttaaaacccagttccagataggtatctgcaccttgcttaggtttatgcagcgtcacaaatttgtgggtcagattgccgcatccaatctgcgcgtagtcacagtcaaagttttggcccttgtttttcgcgttataccagtaacgggcagtgacatcttttaaatcaaccgtcgcattgccgttattttttatgtgaagctgcgggcggatttggttgctgttcacacccccatcccctgctttgtattgtacagaaatgccgttttcctgtgcggggttatcttgtgctggcgtttcagggcgttctttcgttgaatctttgttgccgagaatgttttctcttacgaatgttcctgaagcagttaaatctgtaagcggccagccgcctgttttagatgctcccggctttaacgctgaggatgattcctgcttatcagaaagattccagttcacccagctgatgttcttgctgtcgagataattcagccattcccgcgactggtcaaggaatacaccgccatttccagacgcgtcgcttgttccccattccgtcacgaaaataggcgctcctttactgagtgcatagtttgctttatcccgtaaagattggccgtgtgtgccggcataaaaatgaagcgcgtacatgacgtttgcatcttttagctgatcatcggctgcatcattcacatcttggctccatgtaccggttccgacaatgatgatgttgtctggatcatttttgcggataacggaaatcacttcttccgcatacggtttaatatcacgcttccagttcacatcaccgtttggttcgtttgcaatttcataaatgacgtttggcgtgtttccgtaaagacttgacatttccttaaaaaattcttttgccttctctttatgttggtttgggttgccgtcatttaagatatgccagtcaatgatgacatatatcccaagttcttttgccgcttcaaccgcttcttttactttatttttcacggacggattatcaatataaccgccatctgccgtatacatcgccgcgcggaaaacggttatgccccaatcgtctctcagccattttaagctgtctttattgacaaaatcgccataccattgcaatccatgtgaactgatccctttcaattgtaccgctttgccgtcccggtttacgagctgtgttccttttatgctaagctgcccattcttggctgctggcgtttttgtccctgctgcagatgcctgggaagcctgcaagccgcccattgtcaatactgtaatcaataaacacgtaataaaaatagaaattgaccgtttcatatctgatcttttcctccttcgcattattttggctcttcacttcttatgagctcgaactcattgtaaaaatctttctcatgattgtctatcaacctaatttcttgtttttgggaggtttaaaagcctgtcaatttgctctaactctattgaataagacacacctgacacatatagaacaaagaaaactggactgaatcgggactttacacgttatttttcaatcgaatcgaaaaattaaatgtatttccgacgtagacgctctaaatgtaatgtgatgagtctcaatatggcattgaatcttatgattgctgtaagaagacgagcccttgcccgtccttgttaatttaaggttgatgtaaggttcggattaatacgggttaaggttggagttgtacaataagattgtacttcagtgtgggattcagccagaagaattcccccttcaataaatcatagaggtgaaaaggtttgagagaaaataaaattttgtcttcattatgttacttcagtatattttttgcgccgtttctgtttccgattatcgtctatttcttaagccgggacgatgtgaaagaacatgcgaaaaaatctttgtggacgcatctgattccttatttgatttttggaattggcatcatcgcttcaggtttacttggtatgaatgatatcagacatgccgggcctttcctgcttgcgacttatgctgttacattccttgtggcgatctattttttcatttggaacattgtcaaaggaatcaaagtgttttcggaacaataggaaaaaacggttctgttattaatcagcagaaccgttttttttgtatagccattatgataattgtatatctatcgttgtcccttctcccgcggtgctgtgaatggtgatgtcccctccgtgcttttggataatatcctttgctatggccattccaagaccagagcctgcatgcgtcgttcctgtatttgtccccctgtaatagcgatcaaacactttttccagctcctcttcttctatccctttgccgttgtccttaattgtcacatgagttcgttctttttgttcaagctgtacaacgatcttcacatcgggatcattgtgaacgagggcatttaaaatgagattcgtgaccgctctccgaatcaatatcgcatcaaggttcagcatcagtttttccaggttcgtttgaagctcaatggacttatccgcatatctcgaatcgtttaaaatatcaattaacgtttcccgcagcagcgatacaaggtttacccgttctttatttaacatcacatcgttgtttttcagccttgtcgttaaatttaaatcttccatcacatctttcatatagagcgatttactctcaatgatccgggcgtaatctctgatctgttcgactgtgagatgataattcggatctttgatgatttctgcatagccttgaatagatgctaatggtgttttaatgtcatgagaaatatgactgatccactcttcacgcatttgctctaatttatctttttcttttttgcttaaagatagttgttccgataagtgattgacattatagaacacatctttataaatgcctttggatttcattttgatcgtataatctccattagctaaccgctggattccttgaatgacacggccgagcggttttgtgagctgccggctgaatagatagccaatgagtaacgcgatcaatgcatctattgataataatatgatggttcctgtattgaacttcgtcacaaattccttggtatcatatgagaggacaaattttccgagagagggatttttaaaccctataaagtaactgtactccttgccgtttactttttttccgccggcgtaaatggttgataataattgttcatccttatatttatgtaaatttacaatttcaataggcgtatattttttcttcagtcctttaggttctctatcatgataaacatcctgtccgttttcatctaatatttgaatccatgcattctgctcttttaaagctttttggccctctttgtttactgtgatacccttgttcgataacgtgacatattgtccgaatgatcttgtgaaagtttcaggtgtactttcttcgtcatgttggctgttcgcctgtaaaacgagccaaaacataaaaataaataaattaatgaagactgtaatgatggtcactatgatgacagataccatgtatctgcctgttaatcgccaattcatccttacgcatcctttacaacaaatttgtagcctaaccctttcacagtgacgagaaagtctggttttgatgggacagtttctattttctcacggagcctgcgtatatgaaccatcaccgtgttgtcagaaccgaaaaagtcttctccccatacagcttgatagagtgtttctttactgatcacccgattgggatgctgcagaaaataggccataagcataagttctttaggtgttagctcaatagccgcttcatttttggtgagctcggcttgttgttggtttaattcaaatggccctttttttatcacggttccggtttgagaaggctgtaagtaagagacccgtctcagctgcgctttgacccggtatgcgacttctttagggctgaaaggttttgtaatgtagtcgtccccgccgatggcaagtcctacaattttatccgtttcctccccctttgcagacaaaaagataataggaatgtgtgaaatgtcccttatttgcttgcagatatcatagccttcaccgtctggcagcatgatatccaatatcacaagatcgggattttcttgatgaaattgagccaatccgtcacgggcagttgaagcggtcactacgcgatcaatgccttctcttattaatacggttttgatcagttccaaaatttctttttcatcgtctatgattaatactttgctgtgaagccgtgacatatattgatcactccttgaagtcattgtcattattatacccaatgtccgtgtatcgttaaaaaatcaacattctctcccacagaaaataagccaattttcttttccgagtaagaaaattggcttaatgcaatgctgatgcctttaacgctttacaacaaatgttgtcacgctttgagccggcagatgggcccaaaaatgattatccgttactttgagatccgttccaggttgaagattgctgctgctgctcgtgatccatctggatacttgcgaagcagacccattctgcaacacgaagttttggttgacccctgtgttatttttattaatggcaacaatcacgactttattgtctcctttataggctgacacgtaaacattcggttcaggatttttcgttgcatcaatccttacatagccagggcgcacaaattttgagaaatgagccatattgtatccgcgtttgctgatcgtcccatcttctttcatcgggccgtatgatctgcggatgtaccaccacacataagcttgaaaatctccctctaccattgaatgatgaatatgctctgaaacacctaaagcctcaggccatcgatccgccgagttgttatcactgttcggatagtatacttccgtcatccaaaggtccttccccgctcctttttgtttgaaaagaggataaggaaactgactgacctgagtgccgtacaggtgggttccgaggatatccatattcctaagcgcctgcggatcgttcaaaatggggtccgatatatttttcaggtattgaaatgattccggcgcaatcacacgggcattaatggaaccggcattctctctcatgaaacgcaggatttcttgaggcgtccaccatgtccattcgtgagcgtaatcaggctcgttctgcatagaaatcgcatacagattcacaccattactcttcatgaaattaacgaaatcgttaagatgctgtgcgtatgcggcgtacttatcgtatctcagccgcttagctgatgtgtcaccattatgattgaaagtctcaaccatatcgtttggcggattccaaggggaagcaaaaacgattgctccgtgtttgatcgcactctttgcagtctccacttccttgtaccaattatttctattctcatctacatgaattcttaagaccgaaaaacctaactgattctgtccattgccaaaagcggtctcccgttgagccgcagtcaagtctccaatccaagccgggtgattcattcctccaaaaccgcgaatcacttgtctttctgcagatatattaactgttgcatcacttgctgctgaaacttcagtaactcccggtcctaacagcatgacggacagcattgtgaaacataccaataatacacaaattggtttttttacgctcgacatcattttttcctctccttcatttatcttttatagacttagaaaacgtacctttgcttatctttgtgtaaactgccagtaatcaacattaaacaagtttcctgtaccagttccggtaaatacaaagaatacgttgtgaacaccggatgcgccgcttaccgcagtttctatttctctccaggattgcgttccgcctgtggaagggacattcaaggttccgacaagcttaccgtttgcactgtctagtcgcacttctatttttccgccgagagcggacgctacatttgctttaaacgtcctggcaccgcctgacccgaaatctgcatttcctacagcaatccagtctccgttatgaatgtttgtgacatgttgattattgaccggcccgccgggtgctgaggatgcctctgtcaaaatccgtccgttccaggcaaacgtttccgcttctacccggttatatggattcaagttggatagctgtttgacacctgcaaaatttgccgctacctcttgcagggagccatctggattatgcacaagcttatttatatggggagaacggtatcctttgccggccccgtaaagagcggagctgacagtttgagtatgatacaccacataccactcgtttttaaaattaaaaacagcatggtgattgtttccgccgcctccgaaaaatgctcccggatttttcagaaagtgccctctatacgaaaaagaattcataggacttgagctggtcatatagccgatctcacctggaggtttatcggccgggtgcgcgcccccgaaattgatacaataggaatagtaatattttccgttatacttatgcattcccgaatcttcaaacataaaaggcgcatcaatcgtagatgcacttccggcaacactggtcatatcaggccctaatttcatgactcttgctgttttaggattggcccattgtccctgcgttggatttgaaccgcccggaacgcctccgccggcatataggtaaccggtaccgtcatcatctacgaatactgccggatcaaaaagccatacaacaccggacattcctggtgtacttggcgtcaccagcggttttccgatcggatctgtccacggaccggtcgggctgtctgcggtgagaaccccgatacctccgccgccgtttgcgaaataaaggaaaaatttatccttaccgttgatctttttcaccgcggctgacggggcccatgatgctcctgcccatttggcaatcccccggccgccattcaccccattggcacccgctgcgggaatcgctccgtgatctgtccagttcaccatatccgctgaagatatgacggatattttattcaaattggcaaatgaattatccttaatcgtgccgtcgctattatattcatagtcatcgcttgacatatagatatagactcttccgttataggtcagcgcaaacggatccgcgcccagatgatggtcgataagcggatttgaattcccaacatgttttgcaattggagtgctggcagcatacgcagacttcccagtgaagcaactcaataataaagcaaggacccataggcatacgcaacattttttacacataacttaacactcctcctttttctttaaattcggggaacttttaccatttgagaccaaattgcagtaccggcagtaaaaagcagactccgcagttaagcaactcaataatagagctagtacccataaacatacgctacacttttttctaataacttgacatccttctttttccttaaaatgtatgatgatttttttaccatttgatgacaaccagtcatggagaacggctctggagtaagccttgcgaacacaggagtatgactctcgcctttttaataaaaaacgccgctgagtgccaggccagcggcgttttacacttgatcacttacattttgtcaaacttcgtgtcgccagcaaacgatcctattgacagttgttcttcaagaacaagtccgtgatgatgccgttcttcaatccgtttaataatagatcgaattgcatccgtattttcttcgatattgtgaggttcaaagatcgtcacgtgatctccttttaatttgtactcaagataatgctgtgctgttgattgtgtccagcccctatcatcggttacatcgccgcatagcaaatgatggatgttggcgttaacggcgccggaattgatcagttcattgtgatacgcaagatagcctctgattttatccttaatcgaaggaatggttaatatttctctgtagtagtccggaataatgtccatattcagatggacgatctcttggatttcctcttccgataaatgagttaccgaatcggtgattttagaatccagcataatcacatcagatacggtgcgcccccgcttttctaaggctttggcaacctcaaaagccaaattcgatccggaagagtaaccaagcagaacaaaaggcccttgttcttgaatgcttatcatgctttctgcataccggtcaacgatctctttcccatgagacggctcttctaagaaatcagcggcatagatggtgctgacgccgtcaagtcttttcgccatttcattataaacgagtccatacccgattaaaggcgggaaacagaacacagggattgaatcttcctgattcagcttgacgaatacgttatccgtctcggattcgaaaacggccgcttgaatggcgcgtgccattgtttcgatggtaggaaaatcgtatacggcttgataatgcatgttgattcccatactggcgttaatttgatgaatgagctgcaatactttaagtgaatggccgccaacgtcaaagaagtgatctttaatcccggggtcaggcagagctaaaatatccttccatatatcggccagctgcttttcaattaacgttcctggcgctgcgtattcggttccggtaagcctatttccctcaggagccggcaacgcttttcgatcgatttttccattagcggttatcggcatattctctacttgtacaaaataagccggaatcatatacgtaggcagattgttcagcaaatgacgcttcagctgcgccgtatttaatgactcgtctcctgacaagtaagcgcacagctgttttgagccctctttttcaatcgcgatgacgaccgcttctttgacagcatcgagttgtagtaaagatgcttcgatctcgccgagttctatccggtagcctcggattttcacttgatgatcaattcttcccaaatactcgatattgccgtcaggcagccatcttgccaagtcgcctgtacggtacatcagcttccctgcttcatatgggtgagctgcaaacttctcagccgtcagctccgggcggttcaaatagccccgtgcgagcccgtctccggcgatacacagctctcctgccacaccgagcggttgaaaatattccgattcggggtgtacgatatacaattgaatgttggaaatcggtttacctatcggaactgagttaagcgtttctcccgcttcgcattcaaaatacgatacatcgatcgtcgcttcggtcggcccgtataaattgatgatttgagcctcacccgccggtgtgatcaagcgatgaaaccccgcaacgtgcgcaggcgtcaaagcctcgccgcttgcaaatacatattttaatgatgccagctttctctttaattcctcgtcggatttttgctccatggactcaagaaaagcatgcagcatcgcaggcacaaaatgcataatggtgacatttttctgcgcaatcgtatctaagatgacgtcagggttcttttctcctccgtttggaagcaataccgctttagaaccagtcatcgaccaccagaacaattcccacaccgatacatcaaaggtgattggggttttttgcagaatgacatcctgcttatccagcgggtaatgtttctgcatccaaacgagacggttgattacggatcggtgttccaccataacccctttcggtcggcctgttgatcccgaagtatagataacataagctaagtgattcggtccggcagtctgtttcaagtttgaaccatcttcccaagagaatcgcggatcttccaggtcaagcacttttcccgtaaaaggcacgcttttcctcaagtgactctgtactaacaacagcttcgtatccgaatcctccaatatatagtgaatccgttcttccggatagctcggatcgatcggcacatacgcgccgccggcttttaagattccgaagagtcctacgatcatttccaaggaacgttcggccataatcccgaccggctgatccggctgcacgccttctgattgcaatgtccgggcaagttgattggctctttcattcagttcccggtatgtcagctggctttccccgtatacgacagccgtttgatcaggcgtacgctgtgcttgttcctcaaacaatttatgaagcgtcttttcctttggataatctgcttccgtatcattaaatgcctctataaggagcgaacgttcatcccccgtaagtatatccaagtcttggacgcgaatcgcctgactgttcaccatctgcttaatgatttgcataaaatgctcttccatccgcttgacacttgcatgatcatagacgttgctattgtatacaaaatgaatgtcgatttctcccgcgggcatgacaatgaaattgaaatcgtaatgggtatgctcttccatatggaaattgataatgtccagtgcgtcacgattcggtttcatatgctccatttgtttctcgaccggataattttcaaataccatgatatgactgatcagctgctgcttttgttcagtttgagcctgaatttcatataacggaaatgtatcatacccttgagaagccaatgcctgctcctggctcattttcaacacttgttccacagtcattccaggctgagcggtaatacggacgggaatggtgttgataaataagccgaccatggactcgatacccggaatttctgccgggcggccggatacaaccgacccgaaaacgacatcctgactgttgttgtacctttgcagcaatagtccccacgcactttgaatgaacgtattcacggtgacgtgatgcttgcttgcagtctgtctgatttcttctgacagctgttttccgagccggcatgcaagcctttgtttttgatatcccttggcttggtttgagacaggttctttcagtaaaacagtttgtccttcataaccgtccaaatatttttgccaataggctgaagcgtgcttatgatcctggtcttccagccattcgatatatcggctgtacggggtgacgacttcccgctccgcttttcttctatcaagaatcgcataataggtttcaaatacttcattcgtaataagaggcagacaccagccatccattaaaatatgatggaagctccatatcaatcggacttggtcatcctctgtacgaaggattgatacgcgcattaatgcatcttggataaggtcgaatcctcttgccttatctttttgtacaaagccggcaatgaactcgtttcgttgtttattcttcatgcttcgaatatcttcaacagttatttcgatcggtttttttcggaatacgatctgcaaaggctgatctttccattccgtataaaaatgagtccggagaatctcatgtctttccgccagctgcgacaaactcattgtaaatgcctcgatatccaagccgcctttgagatcaaaaacggcttgttcaaagtaagctctggaagccgaatcgattaaactatggaacagcatacctttctgcatgggagttaatggatatatattttcaatctcgccgatatgttgtgtttgctgaacaaattgatctaattcctcgattgttatgtccttcagtgagatatcgcttggcgtcaggtgaatgtcttcttgagctgcgcaatgttcgatgacttcttttaggctgttctttaagagagctgcacatgtttccatcgtttctcttcgatattgtttaccgctgtaactgatggccaatgacagccggccgtctgagatcatgccgttaatgtcaagcgtataggcaatgggatgtctgtcgcttgcaattttccctccggagtaaggagatacttcgattcctccattttcgagatcttgatcaaattgtccgaggtaattgaagctgatttccggatgtccggtccattctgatgccttcggatgatcggacgaatatttcatcaggccatatcctattcctttttggggaatctgacgcagctgttctttcaccgtcctaatccgctgggagatgtcccggtctgcctggatttgaagagaaaccgggtattgggttgtgaaccagcccactgtacgtgaaatatcaacgtcttgaaaaatagattccctgccgtgtccttccagatgaacatgaatttcttcatgccccgtccagcgatgaacagccattccgagtccggtcagcaataaatcattaatgtcagtcgtataggccctgttcgatttttttaataaatgctcggtttcttcctctgtccattggacgatgatcgtttcccggtcttcggccagaccggtctcctgctcattatcctttggcaatttgtgttgcgagatatgtttctgctcaagccaatattgattttctgcttcaaattccggactttctgcataacgtttcaatcgttcagcccataacagataggaatccgtcttcttagggagcgtgagcgcttctccgttttggagctgctcataagctgacgttatatcctcaagtaaaatcctccacgatacgccatctacaaccagatgatgaatcgcaatcagcaaatgatcgccatcctgacattgaaacaatcccagtttcatgagcggtccatcggctaaatggatggattgctgaatgtcatttgctatcgtttctatcgtttcggcagggttgttttcttcgagtaaagagaacacgtcgaggctgaataattctccttcactgatcccgcgggttctggcttcgtattcatgatctccctgaacatagaccatgcgcaaagcatcgtgatgctcggcaatcttcttcatgactttctgaagcttcgattcgtccaaaccccctttaaaataaagcatgacagattgattataatgatgcggatcagggtattgccgggcgaaaaaccaatgctgaatcggcgtcaataaggtacggcctttgatctccccttgttctgcgattcgggtaatgggctcaataaaaggagcaagcccggagatcgtcgggtgtttgaacaagtgtttgatgtcaagcttatacccggcttgatataagcttgaggtcacctgaatcgacttaatcgaatctcctcccagctcaaagaaatgatcatcgattccgacctgttctgcgcctaataccgattcccacaccccggccagtattttttccagttctgtccgcggagctgtataaggatttccagtgagatttcccgttggagcaggcagagcctgacgatctatttttccgttggaagtaagcggcatcgctgccagctgtacaaaataagcagggatcatataggacggaagttgccgggacaggcgctcccgaatttcgcctgcggttaaagaatgctgtgcggtataataggcgcacaaggatgtttccccgttggtttcttgtgccgtaacgagagcttcttgaatcggcggtatttggaaaaatgcggattcgacttccccgatttcaatgcggtaaccgcggattttcacctggtggtcgatccggcctaaatattcaatatttccatccgggagccgccttgctaaatctcccgtccggtacattttcacctctggcacaaaggggtgctgcaaaaatctttctgctgttaattccgctctgttcaagtatcctctggcgatgccgtccccgctgatatagatttctcccggaacgccggccggcaccggcttcatgctcttatccagcacgaaaatgttcatgttgtccgcggcggttccgatcggcactgattcccgtctgtcgttttgcggatcaaaggaataaatcatacagccgacgactgtctctgtaggcccgtattcgttaaaaatttcgatttttccgccgaattttccgctgatgctacgggcgagccgcgtgcttaaattgtcaccgccgacaatgaatttccgaatggtgcactcagcagggatattcatctctttcaataactgcaagtgcgccggggtcagcttgataatatccgtccttgaatcctgaataatgcaatcaagcaaggcagcactgttttctcctccgtagacaataatggaatttcctgtaattagcggagtgaaaacagacgttatcgtcagatcaaaagcgatggacgaatataggggaaagttggttttttcccctttgacatagacccggcgggcccaccaaatataattggttaagccctgatgctcaattgccactcctttaggcttgcctgtggagcctgacgtataaatgacataagccaaatccttcgtactgctgatcggttccaggtcagagccgtcttcgtggtaagagctttcctgatcgaggaaaaccattgtgcccgcaagttccaactgtttttgaagatggctctgcgtcaggatgatatcagcttgggagtcttctgctatatactgtatgcgatgcttcggataatccggatcaattggcacataggcccctcccgcttttaaaacggccaatattcccacgaccagttcgatctcatgctcgcaaataatcgcagtgagccggtccgtctttaccccctttttccttaacgttcgggctaattgattggcacgttcattgagctgacgatatgtgaattgcttttctccgtaaataacggctgcttgatccggtgttcgtttcatctgttcttcgaataactgataaaccgtcttatcccgcggatattcagttttcgcagtttgaatgtcaacgagaagtgtatgtgtctccgattctggcaaaatatccacttggccgagggggaggtcaggctgaaataatatgacagaaaatagccggtttaaatgtccgagcacctgcatcatatactgacggtcatagacttgttcattaaaacataattttaggtcaatcaagtcttcacccatagcaaactgaaataaagcatctgcagcagccgtttctatgaaaccatcagaatgaatttgctctagtgaaacaactgtatggatgatcggcaaatgatttgcattgtagttcagcctcagctgtccggccattttatcaaagggaacgtcctgatataagatcgcttcgtccagcgtatgtttcaattcatggaaaattgatttaaacgtactgccggaattgatctgctgtttgattaacatgagctggtctgaacgaagatcttcatcagtttcgtcttcaaaggctggaacccctgtaatcactccctcatcccccgtgtatttgtataaaagggattcaattccgaccaggagaaccagatagacggccattggcgtttggttcgtcatggtcaggatgcgccgtgatacctccgcactcaatgaactgtgaatacagtcagatccgcttgttatatcacgctttactgttgagtcggacacttgaaacgaagggaatgcaccgggacggtcttccgtgtgaaacattcggccccagaacaactcctgttgtttgaattctgacattcatatccctccagttggtttcattcctgttttcaggcagctggcggcagccgcggcattcatgccgggacagccgctgcccccgtgattagaaatccaattcgattgtgcttgcgagatgtttacttttgtttactttttcgcttaattgaatgtcttttaaaggaatggatgggtttctcataatcgccgaaaggatcatgacgtaatccttggccaatacagcaatggttttctttttaaacagttttgtacagtaatcaaaactgccctgaatctcatcttgatctattaagaagttcagctgtaaatcaaacttggctgccgtctctgtttgttcataaggcctgactgcgagagagtccacttcaatatccgtttgttccgtattttgcaggacaaacatcgtatcaaacaatggattgcggcttaagtcccgttttacacccagtttttcaactaattcttcaaaaggatactcttgatgttcaaaagccttcagcatggtttctttcgtttccgttatataatccaaaaatgtcttttccgccatcggagcggtgcggatggctaatgtattgacaaacattccgataatgggttccaaatccgcatgcggtctccccgcaataggtgtgccgacgacgatatcaccctgaccgctgtatttagccagcagtatggaataggccgagaacaaaatcatgtaagctgtcgtcccggtcaattcttccagctgctttatcccttgggtgacagtcttatcgagcgtaaaattgtgccttttcccatcaaagcttctaaccggcggtctcgcaaaatctttcggcagctcaaatgaaggcagctcttcatgaaatacaccaagccaatacccttcctgcttcttgattcgttctctttgctctttttgatgtttccattccgtaaagtctttgtactgaatacggagcggagctaactctttgccgtcatacaattgaatcagttcttcgacaaaaatattcatggaggcgccgtccgtgatgatgtggtgcatgtcaaacatgaaaatatgcaggtcttgttctaactcgatgagtccggccctgagtaatggagcctggctgagatcgaacggccgcacgaaggtgcggaaacattcctcaacctcgtcagctgttgccttgtatctttccatcgaaaactccgcttgcggtttgatcacctgcaccggttctccgcggaccagctcaaaaccggtacgcagtgattcatgacgctggatcagtctttggaaagcggtttgcaagcgatttatgtcgagttttccttctaatgtaaggattcccggcatattgtagctcagttctccgccttctatttgtgttgacaggtaaaccatcttctgcacggaagatacaggatagacatcttttgctttggctttcggaatgtaatccggcccgttggtttcagctcctgcaattgcctttgccatttcctcaactgtcggacattgaaagacctctcttaatgaaatgtttttgctgaattgcttatgaattttggcgatgagcgtcatcccccgcaacgagtggccgcccaaatcgaaaaagttatcttttacacctatttcttttaccttcaaaacgtcttgccagatgcatatcagctgctcttccatattcgtccgcggagcaacgtagtcggttcccgtttgtaaacctgcttcaggcatcggtaatgctcttcgatttacttttccattgccggttagcggcagtttctcaagctggatgaagtatgaagggatcatgtatcccggtatttggccagcaagtttttctttcagctgactgatcgagagtgattgctccgctgtaaaataggcatataaatcgatttggccatcggtattttcttttgataggacaactgcttcctgtacgtgcttgagaagagcggcctccacctcaccgagttcaatccggtaaccgcggattttgacctggtggtctctccttcccgcatattcaatgtttccgtcaggaaggtaacgggccagatcgcctgttttatacatccgctgattcgagtcatatgggtgcggaacaaaagtttcgagtgtcaaaggctccctgttatgatagcctctggcaaggctcgctcctgaaatacaaagttcaccgacgattccgacaggctgaagcgttccggcttcattcaaaatgaaaatctccgtatttgaaatcggtttgccgatcggctgaagctcctgatctgtatcaggatcgacggtatacatggtcacaacatgcgtctccgacgggccataatgattatgcaatgtgacttgatggcgtgccagcatgtcacgcagcatacttgttacgatgagctgttctcccgcagcgatgatgtgatccacgcacgcggcaaacggttcgaaatattgtttctctgaggcaaggagcttaaggaacgctgtcgggaggaatgctgtttgtatcccgtgcgttctgacaaaatcattgagctgacgtatgtcacgttttgcctcattgccgatgataaagagtgttcctccgcttgaaagcgcggagaacatttcttgatagcagacatcaaagctcatcgcggcaaattgcagcactctgtcaaagcgaagctgcgtatgatcctgctcataagcgagcagattcgtcatcgtcttgtgctccagctgaactcctttcggctgccccgttgtgcctgacgtgtaaataacatacattaaatcattttccgagcaggaaagattaagattgtctgctctgccttgatatatcatcggatcatcaagctgaagcacttctccttcaaagcgcggcggaatagcgtggcctgcacaagtcaaaagcacaccggcgccgctgtctttcagcataaaagcccgccgtttttcgggaagctccggatcaataggaagaaatgctgcgccggcctttaatatggctaaaatgccgatgatcatatgtgctgagcgatccgtgagaacggcaacaacctgatcagtgcaggccccttatcttgaaggatgcgcgccagctgattggaacgctcattcagctgacgataagtcagtgtctgaattccaaacatgacggcttcatgatccgggttaagctcagcctgctgctcaaaaagctgatgaatcgttgtcggaattcgtttttccgcaactgcagtatcgttaaagagttgctgaatgtctccttcctcttccttggtcatcatattcagacgagccagctcggcatcaggctgtttaataatcgaatcaatcagctgcacaaaatgccccatcatgcgttcgatcgtttccggtttaaacagagccgtcaagtattccattgtgaactgaatacccgactcttcttccacagccgttaaggttaaatcaaatttagccatcgtatgttcgcttggatatggtttgaaagtgacgtcatttatctctaactgttcctgctccgtgttttgaagcacaaacatggtgtcaaacaatggattacggcttaagtctcttgcgatattcagttgatcgatcagcgcttcgaacggataatcttgatgctcataagcttttaatgcattctccttcacctcggacagatactgagagaacgtcttccctttttcagggtaatttctcatggccaatgtattcacaaacattccgataatcggttccaaatcggcgtgcggtcttcccgctataggactgccgacaattatgtcttcctggccgctgtattttgaaagcaataatgtataagacgcaaggagcaccatatataaagtcgattcagtttgggatgccagctgctttaacccggcgcttttttgcttatcaagcgtaaactgcattgtggctcccgcaaaatcccgtgccgacggccggatataatcggtcggcagatgaaggacaggaacgtcgccgctgtacagctctaaccaataggcttcttgattttggatctgttttaaccgcgcttcgccggtctgccatactgcgtagtccttatactggatgcgcaaaggcggtaatgtttctccttcataaatgcggataaattctttaatcaatacactcatggatgttccgtcagaaataatatggtgcatatcaaacatcagaattccgcggtcaggttgaagttcaatcagccccacgcgaagcagcggcggctcatccagatgaaatggacgaataaatttgcggatataaaggtccgcatcattttcttctgcctgataccactctgcttcgaactttgcgtgatctaagacatactgaacgggttctccgtcagccattttaaaaccggtgcgcaaagattcatggcgcaaaatcagcgtgcggaaggcttgctgcagcttgtcacggtcaagcttgccttcgacagccatcagtcccagcatgttgtaactgagttctccgccttccaagtgattcaggatgtacaaccgtttttgtgctgaggataccggataataaggtcttttttcaattgcaggaatcgcagcatatccggtcagctccgtcttcgtgatcgtctgtgcgagctgttcaatggttgggagacggaagacgtcccgcaaaggaatttggacatgcaattgcttttgtatttttgcaatcagcgccgttgcccgcagggagtgtccgccgatctcaaaaaagtgatctctgatccccacctgctctaacccgaggacatcttcccaaattgctgtcagctggatttcttccgaagtttgcggcgggacgtactctatgccgccgtcacgctttttgaccggagccggcaataactggcgattcaacttcccgtttggcgtcagcggcatcttatccagctgcacaaattgagccgggatcatatatcccggtaaatgccgggccattctttcgcgaagttcactgatctgtattgtcttatccgcagcaaagtatccgcacaagtaatattcatcatctgcatctttaagggcagctgcggcggcttcttgaatatcaggaacgttcagcatcaccgattcgatttcaccgagttcaatccgaaaaccttgaattttcacctgatgatcaatccggccgatatattcaatatttccatccggcagaaggcgggccagatcaccggttctgtacattcggtcctccggtacaaacggatcggcaacaaatttttcgtccgtcagttccggcaggttcaagtaaccccgcccgacgccgtcccctgcaatatacagctcgccttggacgcccgccggctgcagccgtttttttgaatcaagaatgtacatgcggtttctgcctaacggcttgcctatagggacatagttttggctgcgtgcccacgcattggaagaacattcaatgttgaacagagacgcgtctacgcaagtctccgtaggcccatatacattggtaatcccaggtgaagcgccatgatcgccgaataattgcatgagcttatttaccgtcgttttggaaagtgcctctcctccgattaaaagatgctgaagcggaactccctgcaaatcacctgcagctatcaaaagctttaagtgggcaggtgttccgtcggtgatgtcaatcgaatgctgccgataataacggcataaggcagcaccgtctgacacaatctctttcggaacaataaacaaggtatgtcctgacagcaaggaagcatacatttgctgaacagaagcatcgaaataatatggagcgagcatggctacattcagctccgcatcgtaggcagagtaaatttggcgtcgaagtccttcaatcaggtgaatgacctggcgatgttcaattaacgtgcctttaggattgcctgtcgtaccggaagtataaatggcataggccagttgactggactgataagagagtgcaagactgctgtctttttggtgatagaaatgttcctccatgagatcgatacatgttcctgagaagccgatgtcatcctgcagcttcccgcggtaaagcaatacgctgatgcttgaatcatttaaaatataactgatgcgttcagacggagaatcaggatctatcggcaaatatgcgccgcccgcttttaaaactcccaagatgcctacaatcatctcaagcgagcgttcagtcataataccgacaagcttatcgttccgcacaccttttgcctgcaaggttcgcgcaagctgattggcacgccggttcagttctccgtaggtgagttgtttaccctcgaatacaaccgctgtattgtccggagtacgatgcgcctgttcctcaaacagctcatgtatcgtttgttcaagcgggtaatgcatgtcattagactgaaagcggctgagcaaatgttctttttcttgcctagagagaagctccaattcttctattttgacagacggctgctgtaatacttgctgcatgagctgttcaaaatgtccgcagatccgctccacttctgatttttcatattcgttttcattaaaaccgaaatgaacggccagctgtttgccaggtatgacaactacattcaaatcatagtgggagtgttccagcatatgaaaattcgtaatgttcagctccgtactatgatgtcccgtctcttcgacctgctgaccgatcggatagttttcaaaaatcatgatatggtcaatcaggttctgcttttgttccgtttgggcctgaatttcgtataaaggataggtatcgtatgattgggaagccagagcgttttgttgaaccatttgcaccgtatcagcaaaagtgctgtcctcatcgcagcggatgcgaaccggaatggtattgatgaacaggccgatcatctgttccacatcaggaatttccgccggtcttcccgacacgacactgccgaagacaacgtctgcggacccgctgtatttctgtaataaaactccccataacgtttggatcaacgtatttaatgtaacctgatgctgatttgcgatctgctgtaattgttttgtctgttcgtgatcaaatcggcaggtcacattggcataggcgtattctttttgttcatgctgctctattttatgaagaagcgtggtttcacctttatatccttcgagatacccgctccagtaccgctttgccgctccctgatcttggcggtcaagccactcgatatagttgctgtaaggagctgccgatgacggttctggttccctgccttcttgtaaggcgcgataatgatcaaacacttccttcgtgataagagacaggcaccagccatccatcacaatatgatggaagctccaaatcaaatgatatttgcggtcttccatacggaaaatcgctatgcgcatcagcggatcccgagccaagtcaaatccttttgccttatcttctctttgataggctgcgattgcatcctctctcaggtgctcctctatatcacgcaaatctgcaaaatgaatttgcggtgtttgcgttttatagacaatttgtaaaggagtatcgttccagccgctgtaaaaacgggttctgagcacggcgtatgtttcaaataatcgttcaaggcttgctttaaaccaatcaatctttaattctccctgcaaatcgaacgatgcttgttcaaaataagaacttgaggcctcgtccagcaggctgtggaagagcattcctttctgcatcggagtgagcggatacacgttttcaacctcacctgcatgcggcagttgaatgaggagctgatccaattcgtcaatggacatgccttttaacaaaatatcgcttggcgtcagttccgattgttctctatggacgcaatgcgtaatgattgtccgcaggcggctttgaatcgtttccgataaccgcatgatcgtttcttttgcgtactgtttgctgctgtagctgatcgtaagcttcagccggccgtcggtgatcattccgtttatattcaatacatacggtctttcttgatttccgctagagtctgaaccgcaagaataagaagataattgaaccccatgctgctgtaaatcttggtcaaactgtcccaggtagttaaagctgatctcaggattgagtttcgatggcattccgccgcttaagtaccttgctattccatatccgatccctttatgcggaatttggcgcaatccttctttggtcgtcttgatataatcagagatctctttgcccggctgcgcgtgcagcacaaccggatacagacttgtaaaccatccgaccgtgcgggagatatctatatcttgtataatctgttctcggccgtgtccctctaaatgaatcggaatttgtttcagtcctgaccaatgcgatatggaaagaccgagagaagttaaaagcaaatcgtttatctccgtgttataagcgcgattcgcttgttttaatagcagctccgtttcctctttcgtccattccacagttgctgtttcactgtcttttgcagttgtatgggtttcatgaaaatctttaggcagcggtttgacttcggtttgttcgatctttgtccaatattcctgttcctgttttatggtttcacttttcgcatattctgaaagtctcttagcccataattggaaagagtctgttttttgcggcagttgaatcactcgcccattctcggcttgcttgtagccgctaacgatatcttccagtaaaatgcgccatgaaatcccgtctataatcaaatgatggatggcgatgagcagatgatctccatttgcgcattgaaacaacccggctttcattaacggcccatcacttaaacgcatactgctttgtatctcatcagctttggcttcaattgtccgtcccggatcggaatcttctttcagattcaggacttctaagcggtacagtccgctttgggcgatttcttcattctgtgcctcgcagccattttccgtagtccggaacgtcatgcggagcgcatcgtgatgttcagcaagtttttgcagggtttgacgaagctgcgtttcctgaaaaccttccggcgcatgcagcatgacggcttgattataataatgctgatctgtcgttatttgttcgaaaaaccaatgctgaataggagtcaggctgacttttcctttgacctcaccttgatcggctatacgcagattctgcttgatatgcggactcaattctgcaattgttgcatattgaaacaagtctttgatttccattttgtatccttgctgatttaatctggaggatacttgaatggatttaatggaatctccgccaaggtcaaagaaattatcaagaatactgacgttttcagcgcctaataccgattcccaggcagaaactaatatttcttccgcttttgttcggggagctttatactctgctctgtcctgcagctcgaaatccggagccggcagcccttttttgtttatttttccgttagaagttaaaggcatttcatcaagctcgataaaataagccggaaccatataacttgcaagggtatgagacaattgtttccggagccgggcagccgttgtttgcccgccgcttacgtaatatgcacacaattgtttaaacccgtggacatcctctctggctgtaacgacagcttccttgatcgcttcttcttgaagcagtgccgcctcgatctcgcctaattcgatacgataacctctgattttcacttgttcatctattctgcccgcatattcaatgtttccgtccgccagccacttcgccaaatctccggtcttatacatcttcgctccgggttcaaacgggtcatcgacaaatttctctgccgttaattcgggacggttcaaatatcctcttgccacaccggcgccgctgatatagatttctcccggcactccgatcggcgcgggtttcatattctcatcaagaacgtaaatgctcgtgtttgccgcagcggttccgatcggtaccgattcccgtctgtcctttacggcatcataacggtaaatcatgcagccgacaacggtttccgtcggtccgtactcattgcatatttcaacccggccttcgaactgttcatgaatgctgcgggctaaccgggtgcttaagttttccccgcccacaatcattcttcggacagccgtttgatcggcaatgttcatttctttcaaaacctgcaaatgggccggagtcaatttaatgatatccaccctcgggtctcgcacaatcgattcaagcagagctgttttatcttctccgtcatagacgatgattgcatttcctgtgacaagcggcgtgaaaatagaagtcaccgtcagatcaaaagaaattgacgaatacaatgggaagttggctttctcgccttttacataaacctctttcgcccaccaaatataattggtcaagccttggtgctcgattagtacgcctttcggccggcctgtggaacctgacgtataaatgacatatgccaaatggctcacatcatttatctgagcaaggtcagagccatcttggtgataagaactttcatcatcaagtaaaaccgtgacgccttcataggcaagctgtttcctgacgtcccgctgcattaaaacgattccggcttgggagtcatccagcatataccgtatgcggtcttgcggatattccggatctatagggacataggctccccctgattttaaaacggcaaggattccgaccaccgattcgatgctgtttctcgtgatgatggctacaggctgatccgtctggactcctttcgctcttaacgttcgcgcgagtcggttggcccgcttattgagctctccgtacgtgagctgcctgtccttatcaatgacggctgcttgatcgggcgtacgctgcgattgctcttcaaataattgatgaaccggcgtctgcggaaacggcgcggccgtgtcgttaagcgtctgcagaagggttcttctttcgccttccgttaacaattccgcttgatccacccggatatccgcatttgtcacgacttgttgcaggatttgcatgaaatgttcccgaacccgctctatgcttgcccgatcatacacatttgcattgtattcaaaagagatggtcatctcgtcgcccggtataacggtcaaattaaaatcgtagttggtctgttcttccatttgcacgttggagatcgtgatggatgttccgttctggcggcctatactttccatatactgatcaaccggataattttcgaatatcattaaatgtgtaattaaatcttgtttttgcgttgtgcgcgcttgaatatcgtacagcgggtgcgtctcaaattgttgagacgctacagccctttcttgcgcctctttcataagctcggcaaacgttgttccggcttcacaccggaaccggacgggaatggtgttaatgaataagccgatcatggtttccacgtttggaattccagcaggtcttccggatacaacacttccaaacacaacgtcccggctgcggttatatttctgcagcaaaaccgcccatgccgtctgcagcagcgtgttcagcgtgacatgatgctggcctgccgtccgcttcattttcgaagtgagatcggagcttatgtcacacgtcactttttcaggaacgtatcgtccgtcttccgctgcatggtgatccttaggaaggccggtttgctcctcatatccctccaagtattgatcccaataagccgtggcctttttcgcatcttgccggccgagccattcaatatattgactgtacggagtaattgatgattgttcaggctgcttttgctgaagcaaggcaaagtaattctcgaatatttcttttgtaatcagcggcaggcaccagccgtccatcaaaatatggtggaagctccagataaaacggtatgtcttttcatccgtacgaaggatgaatagccgcattaacgcgcctttttctaagtcgaacccccgcatcttatcttctctggcatactgctgaatcatcgcttctttttgtgattccttcatctctcgtatgtcattgaattgaaaaccgatttttttcgttttgaatataatttggagcggctgatccttccagcctctgtaaaaattcgtgcggaaaatatcatatttttgcgataagccgtccaagctttttgaaaatgaatcaatctccagatctccatgcagatcaaacatcgtttgctgaaaataagcacctgaattcggatcaaataagctgtgaaacagcatgcccttctgcatcggcgttaatggataaatattttccgcttcgcctaattcacgcgtctgctccaaaagctgttccagttcgtcgattgagatatcttttaacaggatgtcacttggtgtgagagaagtctgctgccggcttacgcaatgcgcaatgacttcttgcagactttctttcaacccttgggcaaattgcgccatagtagatctttcgtattgtttgctgctgtagctcagtgtcagtgataatgtcccttcggcaatcatgccgttcaaatcaagcacggccgttctctcttggttttcgttcatcgataaccctgtggaatatggcgatatgcgcaaagcctgatgcttcaggtcttggtcaaattgtcccaaatagttaaacgatatctccggattcagctgcatgctgtcggcttccggatgcccggatatatatttgatgatgctgtaattcattcctttatcagggatgcggcgcagcccttcttttacgatcttgatccgctgcgacaggtcttttccggcttccatcctcaggacgacagggtactggcttgtgaaccatcctatcgtgcgggaaatgtcagcatccggaataatcggttctctcccgtggccttccaaattcacgacaatgtcttccgtgcctgtccacttgtgaacagccagccctaacgaagtcagcagcagatcgttgatatccgtgttgtaggcgcggttcgcttgttttaataattgctccgtttcctcttttgtccattgaatcgtcacttcttcgctgtcacttaataacgatccttcgctgatagtgtccttaggcaatggctgaggctttatgcttgaaagctcagtccaataagcaatctcctctttcatgtcggtttccgccgcatatttggacaattgatcggcccagaatggaaacgaatctgttttttgcgggagctggatcgtttgtccgcgttctgcctgctcataaccgcttgcaaaatcttcgagcaaaatacgccaggatactccgtcaatcagcaaatgatgaattgcaatcagcaaatgatctccgtccggacattggaacaaaccgagcttcatcaatggccctttgtctaataccatgctgctttgaatctcattcgctttatcggcaatcgcttgagccggatcggtttcccctttataattcatcacttccagatggtatagttcactttcatctgttcctgtaattcgcggagcgtatccatccggcgttttttcaaaaatcatcctcaaggcatcgtgatgcgacgcgatctgttccatcgtccggcgaagcggagcctctttaaagctttccgccgaatataacatgacggcctgattgtaatggtgtgcatgcggcatgttttgttcaaaaaaccaatgctgaatcggggtcagcttggttccgccattcacttctccttgatcagccaccctgctgaccggcgctacaaactgactaagttcagcaatcgaggggtgtttaaacaaatgcttcatatcaaccttgtatccggcttgatacaatctggatgacacctgaattgacttaatcgaatctccgccaaaatcaaagaaattatccagaattcctatacgttctgcccctaatacttcttgccagatagacgccagcagttcttctattgtgttccgcggggctatgtattcgtattccgcccgcgtattttcgtcagcagcaggcaaagctttcagatcaatcttcccattggaagtgagcggaatgcgttccaatgggataaagcgggagggaatcatataattcggcagttcccgggataattcttttctgaactgcgcagcggtcaaagaaggcccgccgacataataggcatacaattgtttggccccgtctgcgtcttcccgcgcgacgactgcggcttcacgaacgttttccagattgaacatggctgcctctacctcgccgatctcaatccggtagccgcgaattttcacttgatgatcaatccgccctaaatattcgattcttccatccggcagccatctggcgagatcacccgttttatacatcttttgaccagggacatgcagatgctccacaaatttttcctccgtcaattcaggacgattgaggtagccgcgggccactcccgctcctccgacatacagctctcccggtacgccgatcggctggatttgatggtgcgctcctaaaatataagcttgatggttggccaccgggctgccgattgtgatctgttcatcagcggactgaacagggtgaaatgtagataccacgctgttttctgtcggtccgtattcattattgatccgaatgcgaggctgcagagaatgcagcttctcaactgtatctgtttccagctgctcaccgcctacaacaacatgctgaacatggatgaagtcctctgtgttcatctgttcgatcatcgttttcagaagacggggagaagttgagaaatgagtaattctctcttgttttatggcattttgaatggcgaaagtttctttattctcttcattaggcaataggtgcaaagttgcccccgagatgagcgggccgaagaaatttaaaatgaacgcatcaaaaacatacgggtacaagacaagcacgcgatccgccggagaatgcttaaaaaacgccttcttccattggagcgaattcacaatgccgccgtgttcaaccatgactcctttcggctttcctgttgtacccgacgtataaatgacataggctaaatggctgtgtcccgttgctggtgataacaatgagctatcggcatggtatgatgtttcatcattcaaatcaatcaccgggccgtcaaaggtgagactgttttttaaatgacgctgaacaaggagaacgtctgcatccgcatcatgaagcaaatattgaagccgctcttttggatattcaggatccaggggcacataagcgccccctgccttccaaacggctataatggatacgatcatctctaatgaacgatcagcgagaatggcgactaacgtatcgggttgaaccccgcaattacgcaatgttcttgccaaacggttcgccttctcattcagttccctgtacgtcaaatggtcgtttttaaacttgacggccgcatgctcaggcgttctttctgcttgctcttcaaataattgatagactgttctgctcccggagaaatctctgacggtgtcgttaaaatcaaacaatagcttctgtttttccgcttccggtaagatctctgccgtatggatcgcggcttgaggctgaaacagaatcacagacagcagctgatccaaatgggacacaatttgattgatatagcgctcatcgtacagattgccgttataaaaaagcttcaaatgaatcccgttgttctccaaatcaaagtgaaacagcgtatcggctgcagtatcttctttaaattgcaaggaatgaatttcgttaagcgaaacgacggtatgaatcaacggcagatgctcgtcattgtattgcacgctcagatgctgaaccatttttctaaacggcaggttttgatttttcagagaatcattaacggcttctttcagctgcccgaatacggttttaaatgtactctcgtttgaaagcgtattttttaagaggacaatgttgttaacggctgactggccggctttttgcttcgataccgtcggaatgccaagaatcaggctcgtttgatccgtatatttatataacaagcattcaatacccgccaataaaatcagataggccgccatatcggaatgattcgccattgtcatgattctttgagatacttccggagataaggaacggcagatgcatttttcctggtagccggtacgggcaaacgacgctttatccgctgctttaaagtaagggaatgcgcttaatccgtcttcttcatcaaacaggttttcccagtacgtttcttggtttttaaataccgacattggagcacctcattttatataatttaaagaaataatgcttttccctaaaagttcaattgaatagaatcaagcgcgttctcttcttcctcattgctgccgctcaatccgatatgttcaattagaatgcttggctgttccaaaatcgccgatagaatgtgtaagtagtcgtttgataaaacctcgattctgcttttcttaaacagttttttcgaatattcaaacagtccgtgatagttgtcttggtccgcctgaatcgacaaggtcaaatcgaatttggcaaccggatgatgaaatgaatacggcttgagttgaagagaatcgaaagtcaattcagcatgatcgagattttgcagcacaaacatcgtatcgaataaaggattgcggcttgaatcttttggaagatgcagatgctgaattaattcttccaatggatagtcttgatttttataggcgttcagcatgttttcttttacttcgtttaagtaggcatcaaatgttttacggcccgccgggtgattgcgaatgactaacgtattgacgaacattcccacgaccggctctacatccaaatgagtccgcccggcagatggcgttcctacgataatatcttcttgtccgctgtacttggataaaagaatcgtataggccgccaataaaatcatatacagtgttgctcctgtgtcttcttccatttggcttaaacgctgtttcaagtgttcgggtataagaaattcaaatgattcgccttcgtaatcgcgtatggcaggtctctcataatccgcaggcatatccagtacaggaatatcactgtgaaactgatccagccaatacgcttcctggctcttgatgttccgtttctgaatgtccgattgctgccaaactgcaaagtctttatattgaatagagagcgggtccggttcgttcccctcgtagattcggcttaaatctttcatcagaatattgacggacacgccgtcagaaatgatatgatgcatatcaaccacaagcacgtgccgtgcaggttcaatttcaatcagtccggcccgcatcagcggcggtttggctaagtcaaacgctttgatgaaatcaagcacacggtcttccgctacttcttcgcttgcttgaatccgttctatcgtaaagtcgacgttctgatgaatacgctgtgccggctcgccttcatataaatcaaagctggtccgcaacgcttcatgacgcgcgattaattttcggaaagcggcgtttaaccgttcgggatcgatcgtcccttccacattcatggcacccgtcatattgtaagtcagctcgccgccttctgtgtgacttaacaaatacatacgcctctgagctgaagaaaccggataatatggcatttcctttgcagccggaatcggtacatatcggtttttgtccatgtgtaacgccttgtcagccaattgttcaatggtaggaaacttgaatatgtcttttagagacagattcacatccagctctttgtgaattctggcggctaaggcagccgctcggatggagttgcctccgagatcaaagaaattatgtttgatccccgcatggcttattccgagcacttccttccataaatctgtcagtttggactccgtctcattacccggcggaacatattcagctgtcagctgcagactcgcttctggtgctggcagtgccttacggtttattttcccgttggacgttaacggcatatgctccagttggacaaaataggacggaatcatgtagtccggaagctccgatgacaattgttccctaagctgcgcagccgctataggcttgtcgcttacgtaatacgcgcataattgttttaagccgtcttcttcttctttcactgtaaccgcggctttttgcaccgcttccgcgttatgcattgctgcttcaatttcaccaagctcgattcggtgtcccctgattttgacttgttcatcaatgcgcccgatatatacaagatttccgtccttcaaccgcttagccaaatcccctgatttgtacatcttcgctcccgggacatacgggttttcaacaaatttctctgccgttaaatccggacggttccaataccctctggcaacacccggtccgctgatatatatttcgccgattaccccgatcggaaccagatttctgcttgcatcggccacataaatatccgtattggcagccggagtgccgatcggtacaaattcccgcttgtcccgttctgcgtcgaagtgataaatcatacatccgacgacagcttccgtcggtccgtattcattaaaaatgtccagccggcctttaaactgctcgctgacacttttggccagacgggtgcttaaattttctccgccgacaatcattttccgtattgcggtgccgccaccgatattcatcttcttgatgacgtgcagatgtgccggggtcaatttgatcatgtctattcttgagtcccgcataatctcagaaagcacagcgcttttgtcttcgccgtcaaagacaatgatggtatttcccgtaaccagcggtgtaaatatcgaggtcacagtcagatcgaaagagatggaagagtataatgggaagttggttttctcacctcttacataaacctctttcgcccaccaaatataatcagccagtccctgatgctcaatgaggacaccttttggatttcccgtggaacctgacgtatagatcatgtaggccaaatcatgcgcatcgctgtccgattcaagattcgagtgatcctcatggtatgagttttcctcatccaaaagcacaacgtcaccatcatacggtaattgatccagcaggctgcgctgtgtcaacacaacctccgcccttgaatctctcagcatatattggatccgatcttccggatattcaggatcaatgggcacgtatgcgccgccggctttcagaacagccaaaattccgacaatcagttcgatccgatgcgggcagatgatggcaacgaattgatccgcttgtacgccttttgtccgtaacgtccgcgccaatcggttcgcccgttcattgagctgtctgtacgtataccgctcattgccaaaaataacggcttcctgatcgggactctgttccgcctgcatttcaaaccatcgggttactgtttcgttatgcggatacggcgtctttgtgccgttacactccgtcagcagttgatgccgttcggtttcagacagcataggaacggaagacaatgtcatctccggctgctcaacaagactgtttaagatgccggtatagtgtctggtgatctgttcaatggtgtcttttgtgaatcgtcccggtttataatcaaaatgcatctctatctgttgaccggcatcttcgatcgtgagcatcaaatcatacaaagagacccctggatttcgttctttcactttaaatgtacattcattgtgccggatttcatgaaattcaatgttttgaaacacaaacatcgtgttaaacagagactttccggttgtttcccgctgcacatttaatttctccacaagccggtcaaatggatagtcttggttttcgaaagcgtcaagcgtctgccgctttacttcttccagataatccgtgaacgttctattggcgtgcggcttcgtccggattccgatggtttgtatgaaaataccgatgatcttttcgatatccggatgatttcttcctgaagcaggcgtgcctacgacaatgtcttcttgtccggtatatttatgaagcagcacattataggcggccaggagcactgtatagagagtggtttccgccttttgcgccaaatcttgaagcgaacggatgacatccggctgtaaggagcatgtcactcgctgtccctcagaagaccgttctgccgcttttgaaccgtctgtcggcaggttaaggatgggaatttcgtcttgaaattgttccagccaatatgtctcctgccgcttcatggcatcctcattcagccgttggttttgccattctgcgaaatctttatattcaaattcaatgtccggtaatggtttctgatgatataaagccagcaattcatttgtaaggatgttgacggaataaccatccgaaatgatatgatgcatatcgatgagcagttcggcctgctcgttttcaatcttgatcagctccgcacgaactaacggagcttggtccaggcggaacggttttacaaaccggtctgaataggcatcaaattcgtcccggctcattgtccggacatgaacgttaaaatcaacttcgttttcaagtttctgaacgatatcgccatctataatgtcgaaatacgtgcgaaacgcttcgtgccgctgcatcacttgttgaagagatgagatcagggcttgctcatcgtacttccctgttattgatatttggccgaacatattttgcgccagctgatccggttccagttggtgcaggaaatatactctttgctgcgccggcgatgtcgggtaatacgcttttttctcggcagccttcatcgggaggtgcacgacttttgtttcgttctgaatgaaatgtgctaattccttaacagtctggtgattgaaaaattgtccgatggaaaccttttgatgaaatgtcttctgaactttggaaagcataagcgtcgcctggagcgagtttcctcccagagccaggaagcgatctgatctgccgacccgttcaaggccgaaaagttcctcccaaatccgcgccagctgccgctccgtttcatttatcggcgcctcgtaggcttcagtgaaatttgctgtattgcttcctattgaagagacccgcttctggtgttcggcataaagtgcttgtaaatcatgctgttcttcatcggaaaacagcatcatggcgtcaagagggattgaatctccctcaaccattttttgcagcaattttgtaaaacccgctccccactttttcatgatttccggactgatgacgttcgtattaaagtcgaaatcaagaatatattcttgatgcgcgtctgttatgttaagaaataaatcgtacagggtgcattttaccgggtatgcaacgggctccgcttccgcctttccgaaatgcagctttcgaaaaggcctgtctaaattaaagataatacgcatatccggcacttgatcgtgcggaagctctctggccaccagtgttatcgggacggcttggtgccgcattgcaagattcacgctttctttcatactgccaagataaccggttaaagtgctttctgaagtagacgtgttcttcaccggaatcatattgacgcaatttccaatcagatcatgctgttttatatgcgattgacctgctgcggggatcccgatcacaaggcctgactgtttggtaagccggtgcagaaaaagatgaaatgcacccagcattgtcacaaatacgctatttttcatctgaatgcttaatgaccttaaagcctcgctcaatggccgtccaagcctgacggtacaccggtctccctcatacccgttcggataacggacagaacctgtgctcggcagaattggctgctgaatcggttcagagaaatgacgccgccaataacggaccccttcttcataatggccgctgtcaatctgtgcctgctgccagtctaagtattggcgaaacgaaacatctgcctctttcggtgaaatcggttttccttgtacgattgccgcgtagttgctctccagttcttgaacaaatacggcgattgaccatccatcgacaatgatatgatggaacgtgagcacaatcagatgttcattgtgagccgatgtaagcacatggattctaaacaaaggcttttgttcatggaaatggaacggccgcttggcatcttctgtcagccatttttgaatttccgactgccgatgttcatgcgggtgaacagtaaaatcaatgactggtatttctatattcatccgtttctgcacttgctgtacctcgtcatcgggatgaatcactgtacgtaaagcttcatgacggccaacgatatgccggacggcttgttttaatggtgtatgctgcagttcgccctccactttcagcataatggactggtttaaagcggcggacgcttcattcccgtaatgggatgccataaccaattgtttttgttcatctgaaagctcgtacgcccctgatttgttatgtccgccgtcatcaggggaatccgggccttccggaataaatccgcctcggcgaagatccttcaccgtgtctttaacagcttgaatgatgtgttcaatatcatccgcggtatgcgccgtggataggaagcagttgcgtccttcccacacatagatccctttataattgagatggtaaaagaacaagtcgttatcaagcgatgagacaaaccggaataaagaaccgaattgaaccatgcggataggcacttgcgattgttcaaagaagcgattcagccgatcaaccagggaggctgttttttgattcagctgttcatacaggtgttctccctcggtttgtaaatggcgaagcacggctaacgacattctcatggtaagcgggtgagtattgaaggtgccggccacaaacgtgcgtttcgcctcatcttgcggataggaatcgtccccatactgccaggtacccccgtcgatcgcattcatgaactcagcttttccggcaactacccctaacggctgtccgccgccgatgatttttccgtaggtcactaaatcagcctgaatgccgaaccattcctgtgcgccgccgagaccgatccgaaatccggtaataatttcatccataatcagagctgttccggattgctgcgtgatcgcccgcaattctttcaaaaatgcccgcggctgcaaatccggtctgcggctttgtaccggttccaccagtacggctgccaattcatcaccaagactgcggatcacgtccagcgaatcgggattgttataatgtaaaataatcaaatcatccataaagctttgcagtatacccggagccagcggattcgcagacgcggctccgccttttgtgccggcaacccctaatacgccgtcaaacgtgccgtgataagatcccgagaacgccacgactttctttcttcctgttgctgcccgcgccaaacgcagggcaaccatgacggcctctgttccggaattatagaaagcgaccctttccactccggtacatgtgcggatccggtcggcaacttcaccggcgacatctgacatcgggccgagcggaggcaatgatgaacgggctgaatcatcgataacctgtgtaataaaggaaggatgatgcccgaaaaggttaaccccgaatcccatggtgacatcgatatattcatttccgtcaatatcccacattttagaaccgtcagaacgttcggcgataatcgggtatacgatttccttccaatacgaacggaagctggacaagttgcggttgtttgcatgagcaaatcgggtgttgtccgtatattgtttggaacctttcgttttatctgcgtatttcttgatgaaatcttctaagtattgtttttgccgtgcggtatagtgtccctgttcatgcaggttctgaggctggaaaggaacatagggtttcgcttcttgagccgctttcttttctgcagtgacggccggaggcccctgcttgacagaaggaattgatttctcttgcgctttagcgtattctttctcatcggaatgatgtccgctgtttctcaacaaattaaagctatttaattgagcttgcaaggtatcctgaattaattgattctgagaagcgattattttttcaagcatatgctcttgttgaccttctctgcgatccgattcagactgtgcttctgaaatgacctgtatttcctgcgccggaacattctcttgaggcggagcggatgcaaaggacgatggaacggtctcagccaagtaatctatgacactttgaaggttgttcatcgtatcaaaaaaacgatccattgggatgtctgccccaaattcgtccgcgatggcttttttgacctgtgacagcatgatagaatccattccgagcccgataaaatgagcattcagatcgagttcctccgctctgatccccgaagcattgctgattacagttttcaggaaggattcaatgtgcgacttcgattgattgatattcaatgccgcttctcctctcttttcgtcctcgtttaagcgcaattggtcagcttcagcccagcatcggctccgttcaaacggatacacgggcaatggcgtcttttgtacagtttcacctgaataaagcgcgcgccaatcgataacggctccttgcacaaataattcggcggcgcgatgcagccatgtgatccgttcatcttgcgtacgtaaacgctgcttaatcagtgcggctgcttgtttattcagctcttctttatgagcgggcagcatttccttcatattcttgtagccgatgtatacaccgggaaggtttctgtctccctgaatcaggcgggtcagcttatccgatagttcttgtttaccggatacaatcatggcaatgccatgatccaaatgagtcctgcccgtactggctgtatagcaaatggactttaatgaagcttggctgtcatccgatacatattgccggtactgctgtgcgagttcatagagtgatttttcagtatgagcggataaaacaaataggtgcggcccatgttcatcctcgggcgcatactcactttgagaaatatattcttccaataccacatgagcgttcgttccgctaaagccaaatgagctgactccgcctcgcagcggctcatcaccggatgggaacgctgcagcttcctggtttacgtaaaatggtgaagagtgaaaatgaatgagcggattaggttcattaaagtgcactaacggcggatttttcttgtgattcagcatgaggacagatttgatcagcccgacgatgcctgccgcttcaaacaaatgaccgatgttcgatttaacagaaccaatcgcacaaaattgtttttttgccgtatacttttcaaacgctttacaaagcccgttaaattcaaccggatcgccgagcttcgttccggtgccatgcgcttcgatgaaagacagtgtttcaggggcaatgcccgcgtctttccaggccgtctcaatgacctcagtctgagctgccggattcggtgctgtaatcccggcggttgttccgtcttgattcaacgcgcttcccttgattacgccgtaaatatggtctccgtcgcgaacagcatcctgcagaggtttcagcaggactgcggccgcgccttcacctgtgccagtaccgtctgaatctttgctgaacgttttcgtgtacccgtccgaagattccatatcaagtccgatacagatcggcaagagcgatgtccggataccgccggcaagagccatttcacaatcgccggatattaaagatttacatgccatatgaacggcggcaagcgatgaggagcacgccgtatcgactgtcaccgccggcccttttaaatttaagaaataagcgattcggctggctaacacggaagggagattgcccacgatatattgatgaagctcctccggataattcgcagaaaggagacgttcataatcgtagcccaccttcgagtaccctgcatataccccgacacggctcccgttcatgctgccgccggcatagcccgcatcttcaatcgcatgccatgcagactgcaaaaacagtctttggttagggtccataaactgagccgttttaggagctaaaccgaagaacgagtaatcaaagcggtcgatttcatctaaatagccgcccttcacaaactgattctcattgatttcgctttggatggactttaaataatccgccgcatctttcagccgggatgcagggtattctcgaatgctgtgctcacctttttcaagcagattccaaaaatcatttttagttgatgctccagggacattgagcgacatcccgataatggcgatatctttcggcgtcacgtggcttggtttcgctgccacgtcctgcttgatttcagcccggctttcagacagatatgccgctaaatcagtgatagaaggatacgtaaagagatctgaaacggcaagctcgcgtccgaatttctgttctatgcgctcggcaatctgcgataactgtaatgaatttgctcccatatcaaaataactgtcagcgaggtgaacctttttcccattgagcacatcggaaaagatagacagtaattccgtttcaatttcatgaatgggagtctgtccggacgtttccgggctgctctccaaatattcattgatggcggcagactctgttgaaaaattccctgcctcatactgtctggcaagttcgtagcgtttaacctttccgctggttgttttagggagttttcggatcggaaggacatcttttatgctccagccgccccgcttgagcaaatgcttttttatctctttgacaagcggtgcgaatttttcaggtgattttttgtaaacaacaaagagcacgatttctccgctttgtgtcttttgatcatatacaccgcaggcggcaacccttcctaagtcaacctcttccatttcaatcgcgacccgttcaatatcgtgcgggtagatattttttccgttcacgaaaataatgtccttttctcttcccgttacgactaagttaccactttcactaatgaatccgaggtctcccgtttttacccagccgtcagaagtcagcgctttttccgtactctcggggttgttataatacccttgagtcacattgtctcctttgatctggatatggccgatgattccgtcttctactctttcatttgcttcatcggagatccgaagctgacaatagtcaataggtcgtcccacttcgacgaatgaagcgcaattttgatcctctttgctgacgtttacagctctttcaccaagatttaaatagtcacgatgcaaataaacgggaacgaattctttacctaatttagagaatgctgcgccgaccgaagcttccgctaaaccgtaaacattcaaaatggcggatcttttcagattgaatgctgcgcatcttttcaaaaattcgtcacagagctccggcaatatcggttctgcaccgtttgcgatgaccttgatgtgggataaatcccagtctggttcgtttttcagaaatttaaggaagtagttgtacccgaaattaggagaggatagaatactggctttatgttcatgagcttttttcatccaaagaataggtctgcgaataaataattctgtaggcattagattttgattgattccggttatgaagggaacaaggtggcaggcgatgagccccatatcatgcgttaaaggcatccatgataagaaagagtctttcgaatgaacggctagggcattcccaatggcgcacgtgttatgtattaagttgtgatgcgttaacatgactccttttggatctcctgtcgatcctgaagaaaattggataaaggcgagttcatccgcatcaggttcataaaacgaagcggggtaatcgtaggtttgatcttgaatgatgtcagatttttcgtttaattgatgatggaaatcctgtaaatcgtgttctgcagcgtatttctttattttgtccaatactttttcagaggcaatcagaaacggatgatttaatatattccaaatgcgccagaccttcagcttatggtcatcatcttctccgatactgaccggcaccgggatcattcctcctaatatacaagcccaaaaagcaacgacaaatgatttgttttcttggatttgaaatacaatttcctgcttcggcttaatgccgagatgctgtaaatagccaagatacccttgcgcctcttcaaacaattggcgataagagacaaccgtctcgtttttatcggattcgataaaacggatcccgcgatcagagatattgcttctttcccgaatgacttctactaaggtttggaattgactggtatacataggtcccctcctgggcgctttattttaaaatccgcaattcttcccaagccggaagctgtttagcttcacaaattaatttgcataaatggatcgaatggttgagctcttgttctgagagctcattttcatgtctttccattctctctttcagctcttggatttgcgtaaataatgccgtcgtcatattggaataagccgctgaatccttgttgtaatttcgcgcaatgacggattgaatcatcaatttattcagttgttttttgcgtaaacggacaatatgtttctttctttccgctgaattggaaagcaagtgaacatcagatgtctgtcctaagggataaggtacaatgtgattcgttgtttttctcagcagaccggctaaaacattgttcggacccatttcgatgacttctgtgactccgtgtaaaagcaagtaatgcatcgattccgtccatcttaccggcatcgtcatgtgctgcttgagatgttcgctgatcgaatttccgctgctgtaagggcgtgcggtgacatttgaaatgatcggccatgcggcatcccggaaggaataccggtgtaatacagtctggaattgttcagatgctgatcgtatcagcgaactgtgaaaaggcgcactgacattcaaataagtgtatgccgctcccttttcctccgccatcttgatgacacgttccacagcttgccggtgtccggaaatcacatgctgctgttctgaattcatgcaggctactcctgccggaaagtcttccgtcgacactttcgaacatatttcctgcaacgtttgaagagagaggtgagtcacggcggccatcgtcccctgctgctgaggatccgcattttgcataagaattccccgctgccttacaagtgtaacggcatcctgaaaagaaagggcgccggcacagacaagcgctgaatattcgcctaagctatgacctgccaggaagcggggcttcacccctatttcctgcatatacacttgaaaagcaataacactgaccgttaaaatagcgggctgcgcgttcattgtctttgtcaattcattcatatctccgttaaaacacagtttttttacatccaaggagatcgcatcgctcgcttcttcaaacaatctctttgcgagcacaaaatcattccaaaattgtttgcccattcctacaaattgagacccttgtccaggaaataaaaaggcaagattgttcatgagattcctccgatcatattgaacagaaatacaatatcctacaaattatccctttatctaacatcctagcatgattataacaaatgtgtatagaatactttcggaggagttattgttcgattttacaaacgaattagatatatttattcataaaataaaacatggggtttcaccgaaaatcagtcttaaagagagatgatgaaaagccggagtggagcctgttaccggctcttcatcacttaggtcgcgctcttcatgtttcatatgttttagggctattggcattattgtgtcagaaattacatattttatgtttattgtaaaaattcatttgtatatctgtgaaggattgtaaactgatggcgcttgattataaatgcggcgcagaaatggatctggatgagaaaaatctgcaaggacaaaatacgccgcagaacatgtgaatgacccagcccggataccggttgggcagtaaatcggcctattgagtgaacaagtttttcaggcataaaaaaacagccgttcagagcggctgtttttaaaaaaatataagaactattgagcggtatacccgccatccatgactacggcctgacctgtaaccccttttgctttgtcgctggccaaaaatacagcgtaatcagcgatttccttcactgacagcagccgtttttggggaacgagcggaaagatgacgtcctcaagcacccgctcgtacggtacattccttgttgcggaaatgtcctttaactgattgcggacaagctgagtgtccacatatcccggacaaagcgcattgacggtaatgccgtcagccgcgccttcaagtgcaccgactttcgttaaaccgatgacgccgtgcttggcgctgttatatgccgctttcccgtgaaaaccgatcagcccgttgacagacgccatattaatgattcgaccgaattgctgttttttcataatggggaatgcatgcttcattgcgataaatggcgcagtcagcatgacacgaatgagccgttcaaactgttcggtgggaaattcctcgatgggcgcgacatgctgaatgcccgcattattcacaaggatatcgagacgtccgaattgtttctcgaccgtctgcagcatgtcggccacttgcttttcatttgttacatcgcatgtgatgctgactgcttcacagccttcatctttaagtcctgccgccgcttctttccccgcttgttcgtttacatcagagatgatgacggctgctccttcacgggcgaattctcttgcaatttcaagcccgattcctccggctgctcctgttacaacggctgttttttcaataagcaatgaatccatggcggcacctcctcattttggtctgaccccgttttttaacgactggctgacagtaaaatgaccttctgttttctcaaagacctcctccattgttacaccttcctgcagttcggtgagcgtcatacggccatcatgaaaatcgaatacagccaaatctgtgatcagccgatcgaccacctgcctgccggttaaaggcagcgtacattccgttctcactttagattccccatatttattaacatgctccataatgacaataatccgttttgctccgtgcaccaggtccatggcgccgcccattcctttgatcatttttccggggatcatccagttcgccaaatctccccgttcggacacttccatcccgccgagaatcgctacatcaatgtggccgccgcgaatcatggcaaaggattcggcactgtcaaaatacgaggctccctttacctcggtaatggtttcttttcccgcattgatcagatcggggtcctccgttccttccgccggataaggcccgatcccgagcaagccgttttcagactgaagcaggacgttataatcattcggtatctcattggctacaagcgtcggcatccctatccccaagttcacattcattccgtcctttatttcctttacagcccgtttgatcattcgttttctgctatctctcattctgtcagcctcctttatcatgcttgccggacggtgcggcgttcaatccgtttttcatgaatcccgccaagcagcacatgctgcacaaaaatacccggcgtatgaatttgatccggatcaagctctccggcatcgacgatttcttcagcctctgcaatcgtcactttgcctgccattgcagcgagcggattgaaatttctcgccgtctttctgaacatcaggttgcccagaggatcggctttccaggcctttatgatggcggcgttccctgtaatccctttctccagaagataggtgcgcccgtcaaatgtcttatgttcttttccctcggctactgatgttccgacgcccgcaggtgtataaaacgccggaatgcccgcccctcccgcgcgaattctttctgcgagcgttccttggggcaccaattcgacttccagctccccgcttaaaaactgccgttcaaaggttttgttttctccgacataggatgcgaccatttttttgatctgccggtttgcaagcaagaggcctaacccccaatcatcaacaccgcagttattactgacaacggtcaagtttttcacgccgctgtccctgatcgcgagaattaattgttccggaatgccgcacaggccgaagcctcctgcgatgagggtgtctccatccttgatcagtgcagcagcatctttataagagtccatcacttttccttttcccatattcgtttcccctttctgttttggctacacaaggcccgtcagactgtaaatggcgatgatgacaaacacagctgctgttttaatgacggtaatggcaaagatatccctgtaggattggcggtgggtcaacccggtgaccgcgagcagcgtaatgacggcgccattatgcggaagagtgtccattccgccggaggccatcgaaatcacccggtgcatgacctccggcggaatgtggaatgtattgattgcttctgtatatgctgctgacatcgtgcttaaagcgatgcccattcctcctgatgccgatcctgtaatcccggcaagcgcagtggtcgtcaccgctccgttgacgagcggatcagtaaacgtctgcgatatgccgctgctgaccattttaaagccgggaagcgccgcaatgatgccgccaaatccgtattcggctcctgtattcatcgacgccagcaaggcaccccgatgccctcattcagtccttctttcaaattgaagagcacttttttccaatcgaacaaaatcgttgtcatgattccgatgagcagtgcgagttctactgaccagatcgcagtgacggaggaaaggtcaatcttcccgaacgcttttaaaccgagctgcgcaaaatcaaatccgtcagggtaccaatgcgggagccacatcgtgaagcatttgttcatgatccccacaaggataagcggaacaaaggcgagcacttgccgcgcggggctgggttctgcctcctgcggtaaaacaggcgtatgtttttcattagccagacttgaggaatcctctgcagcggaaacttcagattgaaatccagcatagccttctccggcattggccgcttttttgcgccgggattctaaataaatcattccggccgtaagcacaaatgctgcgccaatcagtccgagccagggagcggcataaatgtttgttttaaaaaaagctgtcggaatgacattttgaatttgcggtgtgccgggaagcgcatccattgtaaaagtaaacgcgcccaatgcaatcgtaccgggtatcagacgcttgggaatatcagctttaataaataggtttttagcaaacggataaatggcaaacaccgctacgaagagactgacgccgctgtacgttaaaatcgcacccattaagacgatggcgagaatggctctttttgctcccacaagcctgacgattgtttttgcaatcgactcggcgagcccggatatttcaacaaccttgccaaaaacggcccctaaaagaaatacgggaaaatacagcttaataaatcctaccatcttctccataaatatattcgagaagaaaggaagtacgaagcttggatctgtcaggagcacggcaaacagcgcacaaatcggggcgaataaaatgactgaaaagccccggtaagccgcaaacatcagcatgcctaatgccaataaaataataacaatgtccacaaatccccctcttttctgctcaatattagtaagcgcttacaaagatcaagaaaataaagcagaaaacatgccgattttgcaccgtttctgaggctgaaaaaatgtgcatcatggtgaattttccgttttggcgaaagaaaaggagattcttgctgtatgatattgaatggctgagcagcgagtttttttagggatagtgagatggatcagagaggatttttgctttataaatatgtattcttttttctttcatttatttcctgcaagaggaaccgataaaatccggccctcctgcatggtcattcagccaaggacaaccggaagctctttgagcgacctaaaaccaatgagcttgcggtattcaaggcggtgtgcggccagccgaagcttaggcatccgctcaaacagtgtgagaattgcaatttgtgcttcgatgcgcgctaatgaggagcctatgcaaaaatgggcgttctttccgaatgcaagatgcggattcggttttctttggatgtccattttatgaggctgatcgaatatgcttggatcgcgattggctgcccctaaaaggatatatacctgctctcctttttttatggtcttcccatttatttcacagtcttctgaagcggtgcgtgccgtcagctgcgcggggctgtcgtagcgcagacattcctcgacagcagtttcaataagcgaggggttttctctcagtgcgctaagctgttcagggtgtttcaataaagtaaacacaccgttgctcatgaggtttaccgtcgtctcgtgtccggctatgacaagtaagatacatgtcgcgagcacttcgtcttttgaaagctgttcccccataataaacctgctgattaagtcttcctgaggatgtgctttccgctcgtgaatcaaatctctgaaatatgcagtcagcctgcctgcggtgtcgcttgctctgactaacatctttcttgaccgggtaagatcaatggcctgaatgacgtctgccgtccattgtctgaattgatatctctcctctttcggcactccgagtatctccgcaatgatgaggcttgccaatggaaaggcaaactctgaaacaaggtctgcgttttttttgttttggatttgatccaacaagtcatgaaccgtttcttttatacaggggcgaagtgattccgccgtctttgcggtaaattctttacctataagcatccgcatccgcttatggtctgattgatttttaaataacagcatatcgtgctggatatgagatagattttgatatttcgttgaagcttccggaaaagggacgcggtttttaaaccgggtgtctttcaaaatcgctgccgcttctttatacccggtgacataccagcccggatgttttaatacggttcctttataaacaggatcaatggcacgcagtttttcataaaacgggtaagggtcattccaaaaatccgaatccgcatggagggacggatgtgcagtcgataggcccgccgtcatcttatacctccgtattgcaggcggattgcaggccggctttcatttcttcaacggattcgacttcaaaccctaaatcatggagcatttgatgatcctctgtttcatgctgccctgctgtcgttaagtaatctccgacgaaaatcgaatttgcggcgtaaagtcccagcggctgcagcgaacgaaggttgacttcccggcctcctgagatacggatttcttttgtcggattgataaaacggaacaaggcgagcactttcaggcaatacaccggatgtaattcgcttaccccttctaacggagttccgtcaatcgcatgcagaaaattaaccgggatgctgtcggcgtcaagcgcttttaagctgttcgccatatcaatgacgtcctgtttcgtttctttcatgccgacgatgacacccgaacaaggcgacatccccgattgtttcgccgtttccactgtattgaccctgtcgtcatacgtgtgggaagtcgtaatgtttgagtgattcctttgtgatgtattgatgttatgattgtaccggtctactcctgcctgtttcaggcgctctgcctgttccggcttcagcagaccgaggcatgcgcagatttttaaaccgtaagtttctttaatttctttgacagcatcaacaacttgatctacttctctgtttgacggtccccgcccgctggcgacgatgcagtatgtccctatattcaagtcatgggcgcgttttgcccccttaagcaatatatgcttatccaccatccgataagactcgatcggcgcttttgatattgaagattgtgaacagtacccgcaattttccggacacaggcctgattttgcattcataatcatattcagctttactttttttccgtaaaatcgttttctgatatgaaaagcggcatgcatcagcaataaaagatcctcatcaggacaatttaaaatggccagcgcttcttgattcgttacttccgccccgtccagaactctctctgcaagatccatccattgattcatgtttatctccccatttgtgtcagattcatgaaagaggaaacatctatatgtttctcaatcatgtgttgaatgttttccggtgaaacgtgatccagcttcggtgtgattcccaaaatcggaactttgcataatgtttcaatcatgctcgggtttgtcttctcgtccagccccggccggctctttacgccgttgataataataccgagaacctctattcccatgtttttcgcatattcaacggttaaatatgtgtggttgatggttccgagatcaggcctggcgacaatcactgccggtaattccaaggcttttatcaaatcactgactaagtaattttcaccaagcggaacggaaatgccgcctgccccctcgacgatgaaacactcatgacgatttttgatcttactccagtgggccatgacttcatccatgctcacggatttcccctcaagcatggcggccgtgtacggcgcaagcggctctttccattcaaatggcgtgatttcttcatgagacagtgcggtttgtgacatgtttttcaacagcgaggtgtcactttccggatgagtccgcggcacgccgcttaaaaacggtttaaacactccgatatccgcctgtttctgcctgaatgccgcggcaagtccgcaagaaacgatggtttttccgacgccggtatctgttcctgtgacaaaaaaacttctcatttgtttatattcagctcttttctaatggaatcaaatgcttccgtcagctcgtctatgtcctgtaagctgcgatccgccgtaacggtcagcctgattctgctttcgccttccggaacggcgggcgggcggatggccggggcgcagattccctttttctcaagcagcgcagcggctgaaaccgctgtttttgcatcaccgatgataacggggataatcggtgtatctccgcctcttacagtaaagcccatatcggccagacgcgtttttatctttttgacagacgactgcagctcacggcgcgtatcgtgcatatctgatatgaggtcaaatgccgtatgcgaagccgcacaaattgacggcgggagggccgtctgaaaaataaacgtccgcgcctgattcagcaaaaaatcaataaaaatgtttgatcccgcggcaaaaccgccttccgttcctacagctttgcttaatgtgccgatgacaacatcaggacaaacaccgaaatagtcactggttcctccgccgttttccccgagtataccggttgcatgcgcgtcatctgctatcacaaatgcctggtactgctttgcaagcggcattattcggtcaagaggcgcgatggtgccgtccatgctgaaaacgccgtctgtgacgataaagcggcggttccgagtctggacggaggcaagttttttctcaagatcagccatatcaatatggcggtacacgatggtttccgcttttgataaacggcagccgtcaacaatgctcgcatggttcagttgatcgcttaaaatgacatcgcctttttgaggcagtgaggcaagcacgccgatattcgccaagtaaccgcttgaaaataataaagccgcttccgtctgtttaaagtcggagattttttgctcaagtttttcgtgccacacagtatttcctgtcgttaaccgtgagccgccgcttcccgctccgaaccggctcagcgctgtttgcgcggctgtgatcagccgttcatcttttgacagacctaaatagtcattggacgcccaggtctgccgcttttgccccttggttttaagagcggtttcctgtgttcgcagcgtccgatacagcccgtctcttttcaccgcatcgagccttccgaggagccatccgtcaaaatccacggccggtcacctcggctatcgcttctttcataatggagatcatggcttgtaattggtcggttgtgctggcgagcggcggaagaaaggcgatgacgtcaccgagcggccgtgtcagcatacccagctctctcattttcaaggacaccttgtatcccatccgcttttcaggcggataaggctgttttgtccccttatcctgcacaagctctatgccgcacatcaaaccgagctggcggacatcgccgacatgaggaagcagcttcagatcatgaagaaattccgcagccgtttttgatttttcggcgactcgttcaacgatgcgctctgattcgaataaacgcagattttcaattgccgcggcacagccaagctgatttcctgtataggaatggccgtggaaaaatgttttcattttgtcgtagtcatcgtagaaggcttcataaatggcttctgtggcaaacgtcacagcgatcggcaaatagcctcccgtaatgcctttccctgccgccatcaagtccggctggacgttttcatgctcacaggcaaacatttttccggtgcggccgaaccccgtcgccacttcgtcaacgatcattaacacatcatatgccgtacacagctttcgtacgcctgccagaaagccttcaggcatgacgatcatcccggatgcgccttgcaccatcgattcaatcgtaagtgcggcaatctcttcgtggtgctttgcaagcagctgttcgagcgcgtgaaggcattcatcccggcactgtacggggtcaccgctttcagatctgtatacataaggaatcggggctttgtagctttcaaacatcagcgggccgtacacatggtggaagagttcaatggagccgacgctgacggctccgattgtatcgccgtgatagccgttctgcatcgaaataaacgtctgcttcttaggtctccctacgtttttccagtattgaaaggccattttcagagcgatttccattgcttccgctccgctgtcggaataaaaaacgcgcgtcagcttttccggtgtgatgcccgtcagcatctcggcaagttctgttgcgggaacgttcgtcatacccagcaaagtcgaatgagcgattttttcaagctgtttttgaatcgcttcatccatttcttttttgcggtggccgtgtacattgagccatactgaagaaaagccgtcataatattcttttccgctgatgtctttcagcatgatcccgtttccgctttcaatgatgaacggatcttcatcgtaatctttcatttgtgtgaaaggcagccaaagatgctgtttgcttttttcaatcattgattgtttcatatgttctcctcccgctgaatgaatacaggctgcttctctaaaaaatggatacagctctccgtatctatggagccatcagtaaagaaaacccggcatccgctttcatctccggcattcttcatcttggcaatccgctgatatcccagcttctttgcagcaacgtaacctgttatgtaatcagggtcatctgaccagcacaattcggcaataattcccggatgtgcgcaaacttttgccgcgatggcatgtgcttcttttattcgtgaattttccggcatgttgtgagtaaaagcccatttttgaaaatcaggtgacggccaatccactcgggatacccgcacacctctattccctctgcagtcaatgcgttttcctgcccggatatcaaacaggaccgctcctcttgcttctgcatattccgaaatgttttcgtacgctttctcgatcatgtgcggaggaatccccgccttttgcagaagcttgcgggcgattgcttgtcctttttccggcgtgtctgtttgatggagggcaaccggcaaagggcggatcgtttcgatcggttcatgaacgctttcaagctgaatctgcataaaatcaggtatccctcttgagtgtgagaagcctttatgtaataagccatctaccgcttcctgtaaaccgctgtaagtgatgagccgttctccgccggaaatatgttttccgccctgctcatggggggcgtttcgggaagctctcattctgacgctgtaataggtctcttcctgcatgaaatttccctcctttcttttatttcgaaatttaatgttaaccaaaataataaaaggttaacactaatacagaatattagtgtcttgcacgtaatatgtcaacctaaaatataaaactgttaacttaatgggttttacaaagcctcattacgttttcatgttttgttcatattttagtaattgtttattcaacactgtccgctaaagtaatccatatcaacaaataggacagcgatccgcatcttacttatgaagggaggtcaaaaccggatgccgttatgctgaaagaaaaagtaaagacagcaggccgtttttgcaccgtgggcgccggcaatacgctgatcgattttggtgtcttctttcttctcaccgcttgccttgtcccctatctgccggcgcagatctgctcctattcggcagggatcatcaacagctatgtgtggaaccggaagtggacgtttcgtgtaaaacacaaggctgacgggaaagagatcgtgcgctttctcatcattaatcttgcagcgtcgggaatcacctttttgctgctgtacgcgtttcaaaaaggcggctgttcgcttttggtgagtaagctcgccgccactatcggcggaatgatgatgaattttatcggaaaccgaatctgggtatttggagattcgctgaaaaacatacaggatcaggagtgaagatgaatgagaaaaaaagtgagaaaagcggtcatccccgcagcgggtttaggaacgagatttctgccggcgacaaaggcgcagccgaaagaaatgctgccgatcgtcgacaaaccggccatccagtacattgtcgaagaagcaagagagtcaggaattgaagatatactgattattacagggagaaacaaacgctcgattgaagatcattttgaccggtcggcggagttggaaatcaatcttaaggaaaaaggcaagtcagagacactgaaggaaatgcagcggattgccgatttggccaatattcattacatccgtcagaaagaaccgctcggactaggccatgcggtgctgtgtgcggagcattttatcggagatgagccttttgccgttctattaggtgatgatattatggtatctgacactcccgctctttcacagctcatagacgtctataaccaacacggcacagaaacgatcggcgtacagcccgtcgatcctgctgatgtcagcaaatatggtattatacagacggggcggcagagcggtcatgtgtaccgggttgaggatctgattgagaaaccggccgttgaaaaggcgccctctcatattgccgtgttgggccgttacatattaacccctgccatttttaaagcgctgaagacgatcggaagaggcgcgggcagcgaaatccaattgacagacgcgctgcgcgaagtatgccgcacccgaagcatttacgcgcgggagcttgaaggaagccggtttgatataggagataagttcggctgttttaaggccggcacggagatcgggcttctgcgggaagaaatgagaccgaaacttttagcttatttagaagaggtgttaaaaagagaatctgaagaaatcgtgcgttaaaaaataatttgtaaccattttgcttgtcaatcagtcatataattgggtaaaaagataaagaggttgtgaacagtgtgggcaattttattagtgaaatattatcctggctgacaagtatgggctatttagggattgcgctcggattaatgatcgaaatcattccgagtgaaatcgttctggcttacggaggctatatggtgtcagaaggcacgatcagctttatcggcgccattgtcgccggtgtgatcgggggaacgatcgcgcagtgctttatatactggatcgcccgttatgggggacggccgtttttggacaagtacggcaagtacttacttctgaaaaagcatcatgttgatgttgcggaaaactggtttcgccgttacggcgccggcgttgtgttctcggcgcggtttatcccggtcgtcagacatgcgatttccatcccggccggccttgcgaaaatgcctctttccaagtttgtcatattgacgacgcttgccattattccgtggtctgtcattttcgtttatctcgggtatcagctcggggacagtggaaagacgtagacagctatgccggaatgtatacaactccgatcattatattggctctcgtatttattgttgtttattttgttgtgaagaaaatgagatcaagactgtgaaaaaagactgcataagaacggctgcgagccggatctatgcagtctttttttatttataccgggtatacggggtgtttccggtgtgtgaatgtcagttgtttggacatgtaagcagtgaggcgtttattgagttcttcccgcaaggaatcagcaggaacaatgccgtcaatcaccatttcagaggcaagccggtaaaggttaatgtcttccttatattcatcacgcttttcttgaataaaagccggcctttcttcaggggccagctcgctgattttgtttgcgtagaccgcattcaccgctgcttcaggacccattacggcaatttgcgcagtcggaagcgctaaacagcagtccggttcaaaagcaggccccgccatcgcgtataatccggcaccgtaggcttttctgacgataacggaaagcttcggaacagtcgcttccgccattgcggagatcatttttgcgccatgcctgatgatgcccgcctgctccaccttcgttccgatcatgaatccgggaatgtctgctaaaaacagaagcggaatatggaatgcgtcgcacaaagcgataaattttgcggctttatccgccgaatcgagaaataaaactccgcctttgacacgcggctgattggcgataatgccgaccggctgtccgtgaatccgcgcgagccccgttattaattcctgcgcaaataacggtttaatctcaaaaaacgagtcttcatcaatgacacgttcaattaaatccatcatgttgaacggtgcgttttgatgtgccgggatgacatctgagagcggtttttcaaaagctttcgggttcttagatttgttgacgggcgctttttcagtataatttgccggaaagtagctgagatatgtctgcgccatcatgattgcttcctgttccgtcggggcgaggagatcaccgcagcctgatacagaacaatgcatacgggcgccgcccatttcttcaagcgatactttctcgccgatcaccatttctgccatgcgcggggaacctaagtacatggatgcattgccttcgaccataatgacaatgtcgcaaaaggccggaatgtaagcgccgcccgcagcggaaggaccgaacaataaacagatttgcggaatgcggcccgacagctttacttgattataaaagatgcggccggctccccttctgcccgggaacatgtcgacctgatccgtaattctcgcacctgcggaatcgactaagtacaagagcggacactgaagcttctccgccgtctcctgaatgcggatgattttttccaccgttttcgcgccccacgagcccgcctttacggttgagtcgtttgccatcacacaaacggttctgccgccgatggttccgatcccggtaacgaccccgtcagccggcagtccgtctgacatgcactcggcgaaaaaagcgtcttcaacggatatgccgtcatcgaataaaagcttcagcctgtctcttacaaaaagttttcccttcttttcgttgcttgcatgatatttcgcggctcctcccttttcaatcgttttgctgcgtgtctgccgttctttttcgtaatccatccgagtccctccatgttttattttcctttgtattcagggggtcttttttctttaaaagcgcgcaggccctcttctctgtcaagtgtagggatgacttgttcatatgcttttcgttcgatttcgagccctgtattgagatctgtctccagacccttgtttatcgcggattttgcttgtctgacggcgatcggcccattagcggcgatgcggccggccagtgcttttgctttttccataagttcatcggcttcacaaacatgctcgatcagcttcatgtcttttccctcttcggcagaaagccttcggccggtatagatcaattcttttgccgcgccggggccgataagccggggcagtctctgcgttccgcccgccccgggaatgattgcaagccctgtttcaggaaggccgaggcccgcccggctgacggctgttctgatatcgcaggcgagagcgagttcaaggcctcctccgacagcggttccgttcagcgctgcaatgaccggctgcgggagagcttcaatggatgcagccgtttcaccgatacgcctgacgctttgcttaacttgttcatgattcatcccagctctttcttttaaatcagcgccggcgcaaaatgtgtttccggagccggtgagaataacacagcgaatggatggcgagtttttgatgtcttcaatcacacgctgtaaatgatcaatcatttctgaagacagcgagttggccgcatgcgggcggttcagcgtgatcagaccgatcgtttcttgacagacggaatacaagacgcaatctcccatggcttctcctttctcatttcgttctgaatgcctgcagatttctgcttggcagatctttgcctattttatccgcgatccagcgggcggcatcaagaagtttattcatgtccgtcccggtatcaatccccatttgttcgagcatataaatgacgtcttctgtggcagcgttgcctgctgatccaggggcgtacgggcagccgccaagcccgcctgaggaagtatcgaaggatgtaatccccatatcaagagcgggaatgatattcgctagagccgttcctcttgtatcatggaaatggagtgcgatttttgaggcgggaattctcggcaaaagggcttcaagcacggatatgacctgcaaggggtttgccgcgccgatcgtgtcgccgagcgatatttcatcaacacccatttcgagcagtgtgtctgacaggcggatgacttgttcgaccggcacgttctgttcgtacggacagccgaacacagtggacagataagctctcgtcgccattttttcagcttttgcttcagtaataacccgcctgagctcttgaacggtccggtcaatcggtttgtttacgtttttttggttatgggtttcgcttgcagataaaaatacacaggcctgatcgattccgccttctgccgcatgctccagtccgatgaggttcggaacgagcgccgcgtagaccgtatgttcagacctggcaatgccttttgcgacgtccaggctgtcacgaagagccggaatccatctcggatgcacgaatgatgtcacttcgatatagggaaggcctgtttttgacagcatattgatccactcaatcttatcttctgtatccacccacgccgattcattctgcaagccgtcacgcggtcctacttcattgatgcggacatattccggacagttcatgctgcacctcccgttttattgaagttcaatcaggacctctccttcatcagtgaaatcaccttctgattttttcacttctttcaccgtacccgctgcatcagcgataatcggaatttccattttcatagattccaagatggccacttcctgtccttcttcaatgacatcaccgggcttcacatgaattttccacaggtttcccgccatctgaatttttatgacgctcattttgacgccccctcgttcattgtttgtaaaaaaccggttgttgcctcacccttttcaaacacttctgaatgtgcaatttttgtaagcagcggaatgttggttttaatcccttctacatgatattcgccaagggcggttttcagttgttcaatggcttgttttctcgtattcgccgtgacgatcattttggcaatcatcggatcgtaaaacggagaaatgacgcttcccttttcgacggcgcattcgtgtcgcactgacgggtgtcttaaaacggaaaaagacgagatggtaccgggtgacgggtaaaaggtgaccggatcttccgcatagatccgcacttctatcgcatgaccgcggtggttgatatctttctgcgagaaagtcagcgcctgcccggcggcgattttcagctgttcttccacaagatccagtcctgtaatttcttctgtcaccggatgctccacctgcagtcttgtgttcatctctaaaaaatagatttgtttcttttggtcgacgagaaattctattgtgcctgcattttggtagccgatcgatttagcggctttaacggcggtttcaccgagtctttgtcttaattcatcgtcaacaaacggcgacggcgcttcttctatcactttttggtggcgcctttgtactgaacagtcacgttcaaacagatgaacggtgttgccgaaagaatctgcgagaatctgaatttcaatatgacgggcattttcaatgaccttttccatatacattgcgccgtctccaaaaaaggacgcggcccgcttttgattgccttcgaacgctttggccagctcttcttctgaatgtacgatctgcatgccgattccgcctccccctgcagacgctttcagcataaccggaaagccgatggcacgggcttcggctaaggcggagtgaacatcgggcaatggctctgaaacaccgggaacgatcgggacctttgctttttgcatcgtttttcgggcttctatcttgctgcccatcttggcgatgatatcaccgggcgggccgataaatgtgatttgttccttccggcagcgttcggcgaacaggctgttttctgacagcagcccgtagcccggatgaatggcgtccgctccggcggatttggcggcttctatgattctgtcgatatgtaaatagctttcatttactctcgatttaccgatcggataggcctcatcagccgcttttacatgcagcgcgtccctgtcggcttctgaatacacagctgccgaggggatgccgagacgtttgcaggtgcggataattcttaaggcgatttctcctctgttggcaatcaggacttttttaaacaaatgtgaagcactcctttttcattaagttaacttgagctcttcaatcgttttttcccgcagcttgaatttctgaatttttcctgaggctgtcattggatattcatctgtaaacaaaacatacctggggactttatagcgggcgatatgttctttgcaaaaggttctgatgtcttctgcggaagcggtttgtccgtctttgagcctgacccacgccgcggcctcttctccgtatttcggatcaggcacgccgacgacctgaacgtctgccactgcgggatgccgatataacatttcctcaatctcgcgcggatagatattttcgccgcccctgatcagcatgtctttcagacggcccgtgattttgcagtacccgtcctcgtccatgacagccaaatcaccggtatgcagccagccgtccttgtctatcgcttcttcggtcgcttcttgatttttatagtaacctttcatgacatgatatccgcgggtgcagagctctccttgttcgccccggtcggcttcttgggatgttccgggccgaacgattctgacttcgatatggggaagcgcgcgccccgctgtttccactcttctttcaaatgaatcatccgttcttgtctgcgtaatgacaggtgatgcttcggtctgtccgtaggcaatggtaatgccggtcatccccattttgccgatcacttctctcatgacttccgccgggcatggcgagcctgccataatcccggttcggacgtgggaaagatcatattcagaaaagcggctgtcatttaggagggcgataaacatcgtcggtacaccgtgcagagccgtgcaggcttcttgctccaccgttttcagaacggccggtggagaaaactgttcgatcggaatcatcgccgcacccgcggaaacacatgccagcacgccaagcacacacccgaagcagtggaaaaacggcacgggaatacataaacggtcacttgaagtaagcttcatgcattctgcgatattggccgcgttatttacgatattaaaatgtgagagcatgacgcctttcggaaatccggtcgtacctgatgtatattgcatatgaatgcaatcatcctttttcaggctgtccatccttccgtcaagcgctgcatccgttacagcttcgccttccttcagcaaagaatcccagcggtgcatcccgggcggacttttatcaccgatatataacaccgtccgtaaaaaggggtaacgtttcgaacgcagcctgccgtgctcacaagttttcagctccggaatcagcttattcaccatctcaacataagatgtctgccggtaggaatccatgattatcagggccgagacgtctgaatgcgccagcaggtaatcgagttctgcgatttgaaaatttgtattaatggtgaccagaacagcgccgattttcgccgttgcaaattgcgccgcgagccattccggtatgttggatgcccatatggccacatgatctcctttttcaattcccagtttcatcagcccttttgcggtttgccggcataaccggtcaaactcggcatacgtataacgaaggccgcgctcagggtaaacaaccgcttcatgatccggaaaaagctccgcggtccgctcaagcagctttccggctgttaaatggataagttcagccatatgacctgcccccttccatccctgtcttagtaaacgttttcatttcacttcaaaagctgtcttgcgatgaccattctttgaatttctgatgttccttctccaatctccatcagctttgcgtcacgaagcatacgttcgacaccgcattccttcatataaccggaaccgccatgaatttggatggcctgaaggcaggttctgacggccatttctgaagcataaagcttggcgaatgccgcttctttcgtaaatggcaggttttgatccttcagccatgccgctttaagcaccatttgtctggcaaggtcaatttccatcgccatatcggccagcttaaattgaatggcttgaaatgacgatatcggactgccgaactgcttgcgttccttcgcatatgacagcgacgcctccagtgcgccttgagcgataccgacagccagtgccgcaatcgagatccgcccgccgtctaatgtatataaaaattgtttaaaacctttttcaggatcaccgagcaggttatcggcaggcaccctgacatcctccagcacaagctcggccgtatccgatcctctcacacccatcttgtcgtacggatttgtgatcgtaaatcccggtgtgtctgtcgggacgatgagagctgaaatgatcggttttccggcggagttctttcccgtaacggcggtgacaatgaccgtgcgggcgtaatttgcgtttgtgatccagcatttttctccgtttatcacatagtcatcgccctttttctcggcttttgtctgggtgccgccggcatctgaaccggcattcggctctgtcagcccgaatgatccgagcgcttttcccgaagcaagcggaacaagatgttcttgcttttgctgttcagtaccgaaatagtataatgggcttgcgccgagtgacacggctgccgcgtagctcagccccgtgctgccgcaggcttttccgatttcttcgaccgctgctgcatatgaaatggtgtcaccgcccgccccgccgtattcttccggaaacggaattccgagcagcccgagttcgcctatttttttaaatgtgtctatcgggaagacggctgattgatcaacctcatgggctttcggggcaatttcatttttggcgaaatctctgaccatttcgcgcaccatctgctgttcttttgtcagttgaaaattcattaaccttcctccttctgctgctttctacattttattaatgggggtctttattcattccatccaaataaagtctgaacattcggactcatccgccgcaaaaaaaaactgacagtgccgcaactgtcagttttattaataatggctatttaatcgtccgttttgcggagggacggctctcatggtgaagcctgtcaacggaagtaacgatataggtgcatgcttcttccgcccgaataacagtatctgaaaatgtctgcgtccgtgacgatgtttttctgactgtatccactaaataaggctgctttcccttttctgcgcggtaaatggcgtaataagccgtttttttaccgttggatttcgcatcttcgatatagagtgtatggcctgaagcgttcttctccgcccgtttgacagccggtttttttaaagcggaatgtccgagccaaggcatctcgggaattaatgcgggccggctgtacatgtcattgatcaaacggtttttcacatcgagcggattacggtttaaatcctttaaactgaaatgcatgctgccttttatccatgctgatcctctgtttagcgtaatctgtcttccgtattcccccgggtcggcccaggccggatcagtattgttgttgattttataagctgcctgcccgatatataaatgcaccggccgattgttcacttcttttccccaccaatccgctaagacgtcatatgccgccgctttaaatccgatactccagtaaatttgcggtgcgatgtaatcaatgtatcctttttggatccattctcttgtatcagcatataagtcatcgtagttccgcaccccggcggccgtttcggagcctgtcggatcatctgcggcatttctccatacgccgaacgggctgattccgaatttgacataaggtttttctcgtttgatggtttcgttgatttcttttacaagccggttgacgttatccctgcgccagtcatcaatcgatgcaaagtgagcttttccgtaccgttcgtattccgcctgatcggggaattcctgtccggcaattttataaggataaaaataatcatccatatgaaccgcatcaatgtcataacggctgaccacttctttgattccatccgttataaattgtcttacttccggaatgcccggattatagtacagctgttttccgtatgcagcgacccagtccggatgggaacgcgcgggatgatcatctgaaagcgcattcaaatttgtgtgattcatcgtgatccggtaaggattgaaccaagcgtgaaattcaagattccgtttatgtgtctcttcaactaaaaaagcaagcggatcgtagccgggatttttgccttgggttcctgtcagatactctgaccaaggcccgtaatctgatggataaaaagcatcagccgcaggcttaatttggacgataacggcgttcattcccatcttctgaacgtcatccagcagcttgctgtattctcttttttgctcttccggtgacagcccttttttagagggccagtcgatattggtgacagacgcgatccatacggctcgcatttctctctccggctgagtgccgcttgcttgtgcggatgctgagaacgtaaagatgccggctgtcagtacaacggccaaaaaccatatcatgctaaaacggcagcttttcatgtttttccccctctctgctttacggtattccgaagcattccgggcggtgaatcagaaagcctgctttgctcctctcagcctaaaagggaaagaaaaaagtcctaaagcgaatcaaaacgcttcaggactttttatgttttatggcggcgagcacgtcaatgaccttcgttccgacgccgacgcatgtttcaagaatggcctgcgctccggcaatggacaaaatgaaaataaccggatgtgcatagcggggccagaccaaatagcagatgccgatcaatatggcgcaccagacgcccgcacaccaataacattgcagcatataaccgaatgcggaggaagggacttttttttggacggcgcgcccgttttgatcgacggttttttcttgctttataaagggttttcttatgaattccgtaatcttatcaaatacgatcaaatgggtcagccggtagctggcaagaataatcattacatacgtaagccaagataggttcgtcatctcaaagcctccaaaaaaactgagtgtgattcccctatcttgccctttgtcttcttcagtcattctgccggatgttacagattccgcgccaagcgtcttccgctgtttgcgatgatgtccagtatgacctcggcatttttgtgtgcaaactcgggctcaaacatatctttatgggctccctcgccctgatattcctggtagactcccgttgtggcgccttcccatttcatcggctcggtcttatcactgtgctcttcctttatgccggcctcaataaaatggagatttgccgcaatttggccgtcatttatcagttccgcccagtacgtttgatagcgctctgtttttctgatgaccgcttccctgacggcttccgggacattttcggctgttgcgtttgttggctgcggcggcagtgcgtcaagctttctgtacgcgtctgcgataatgacgtcgctgatttctaagccgcgcttttccatcgcttttgcagcctcgaatgccgtattgccgcccgctgaatatccgaagaggatataagggccttccggctggatttccagcattttatcaatgtattgttccattctgctgtcttcttcaataaagttaaaaccgtacacagcagcccgtccatttaatgccgccgccagatctttaaagaaaatgccgaaacctgagataggcggaaaacagaaaagattgcggcctttcggctgattcagtctgctgatatgctgttcggcagcttctgacagtgtgtttgaatacagcttttcagccaattgttcaattgtcggatattcaaatatcatttcaatcgggacgtccatctgctgcctggtcttcagctgatgaatcacttgcaatgctttcaaagaatggccgcccagctcaaagaagtcatcctgtatgcccagctccccgcagccgaggatcggcgtccaaatgtcgatcagctcacgctctacccagtttcgtggcggaacggcttttgatgaagcttttttccgttccggcgcaggcagcccgcggcggtccactttgccgtttgcggtaagcggcatacggtcaagcttcatcacatactgcggaatcatatagtcgggaagcgacctggccaatagggatcgaatggctctttcttcagcatgtgcgcctgtataatacgcacaaagggttgcttcttgtccttcgtctgacacgatgactgccgcttccctgattccatcaatttcagtcagccgcgcttcgatttcggccggctcgatacgcttcccgcgaatcttgaattgacggtcgatacggctgatgtatccgatgcttccatcaggcagccagtgtgccaaatcccctgttctgtagatcttttcttcaggatgaaccgggtggctgacaaatgcttcacttgttaagtcaggcctgtttaaatagcctttggcaaccccgtccccgccgacacaaagctcaccaggcacgccgatcggcgcaagtccgccatttttatcaatgatatacgcggttgaattgctgatcggttttccgattgggatcggctgagaaaaatcgtgcctgatttcgtaaaaggtagaaaatgtcgtattttccgtcggtccgtatatgttataaaggctgagattcggacagcggtgtctgaccttattgatgagcgccggggacaatgcttctccgccgacatataaggtgtgcaatccgcaaaacatctccggatccgcctgggcaaactggttaaaaagcgccgtcgtcaaaaacagaatcgtaataccgttggaagaaagataattgccgaacctctcaggggcaagcattgtcgtgcggtcaaccacatggaggcacgctccgttcaatagcgctccgaagatttcaaacgtcactgcgtcaaaaccgatggatcctgtcagaatgagacggtccgtcgtgccggctgacgtgtaattgctgtttgacacgagcgatacgacgttgcggttggaaatcatcacacccttcggttttcctgttgaaccggatgtatacataatataggcaaggtcatcaggtgacgtaacggtattcagttttccctcatcagctgtttgtttttcagctgcagccgggatagagatgatgtgagaaaagtcaatgtcagtctcaatccctttttgtaccgttaacagctgtgctccgctctcagtgagcatttcggcgatcctgtcggatggcagttctgcatcgagcggaaggtacgtccctcccgctttcaatacagcgagaacagcgatgataaattccggtgagcgttcggcaagaatcccggcaattccttttggcgccaaaccgttttccagcaggatgcgggcgaacgcagttgaccgttcatcgagctcccggtacgtcatcgtcagcccgccggcgtgaagcgcctgatggtccggggttttcttcacctgtcggctgaacaggctgatgatgctttcgtctctttcatacgttgttttcgtgtcattaaattcgccgattattcttgatttttccttttgtccgagcatcggaagccgatcagcgggaacatcgggattgaaggcggcgccgcgcagcgcttcttccaagtgtccttttacgctctctatccatacttcgtcataaacgttcgcattgtagctgaatttgatgatcagctcatcgccgggcgctatgatgaggttaaaatcgtagcccgattgttccgaaacattgacattcccgatccggaacggtgcatccgattccttttccgcgtctctcatctgctgctgaatcggataattttcaaacacgatgatatggtcgattaaatcctgtttcagctcagtctgagattggatgtcagcaagcggatgataactgaacgcctctgaatcaagcatttctttctggcagcggcccagcagttctctaaagctttcgtcacccgttttaatgcgtaccggcacagtattgataaacagcccgatcatgctttccacgccgtcaatgacggaaggccgccctgatacgacggcgccgaatacggcatcgtccgtccggttgtagcgctgcagcatcaggccccatacagtctgcataagaaccgcgagcgtagcgccctcttctttggcgatggttttcagcctgtctgtcagattttgatctaaagaaaacaggagctctttcttacggtagccttttccctggggacgggccgatattttcgggagtcctgagggtgtctcgcagcttgctaaatatcctttccaatactcagaagccgcgtctttgtcctgatcagtcagccatgtaatatacgtgctgtaaggctttgcgggcgccagtgtgacgggtgagcctgattcaatcgcccggtacatatgcatgaattcctgaaggacgatgccgaggcaccagccgtccataaggatgtgatggtggctccagacgcatacatatttttcctcagccgttttaaacaaagacacacgcatcagcatatccttttgcaagtcaaagccttttaagcggtcacgttccttaaatcgctgtaagtaggcgctctgttccgcttcatccaaatgtgtaagatcttcgcggtgcagccggaattcccgctcacgcagcacgacttggcgggggccgttcagctgagcgacatgaggtaaaaaaaccgttctgaaaatatcgtgacggctgatgacagactgtacgctttgctcaaacaattccggacgaagccggccttttatggtgaagacggattgctcgatatatgcagccccctccttttgcagaaaggaatgaaaaagcattccttcctgcattcggctgaggggataaatattttggatgttttttgttttgtccatgtgttcctcccgctcggtttagtggaagctgagtaagtcggcaatatcctgcaaggcttcctcagtcagctcccgatcatcaaagtcactgacggtcttctccgtatcggttttgctgaggcagtgttccgacagtttcaggagataataccggcagctttcggacagccgttcgatcgtatcttgccggaagcgctccgtttcataggaaatgctgacggtcatccggccttttgccgcaatagcgctgatttcaagtgactgctcccgtttccatgtatctgtgacatcatctccgcctcccaaaggagaaaactgaaacgcgtcaggctgttccgtttctgccggactcccgccgggcgcatcgaattgtccgagataattaaagctgatctccggtgctttcccgaaagtcatcccggcaagcttcggcggtgttaaatatttgaggacgccgtatccgttccctttatccggaatgcgccgcaatgtgtctttaacggttttcaatgtgcgaatttcatattcttcaagaggttcataaactccgctccggacaagcaccgggtaaatggaagtgaaccaccccactgtcctgctgatgtccgcacctgcctgctccgattggcgtccgtgtccttcaagggcgattttcaaagcgtgctgcggcgaccacttttgaagggcaagcacggcggaagccaacagcacatcttgcgtatccgtattgtaggcgctgtgcacatctttcaacagggcgtccgtttcactttctgtcagagtgaaggataccgtgttccgtttttttgcaggagtttgagatagatctgcctgctcgtaaggaagactttctgtttcatagtgttcaatctcccgccaatactccgcctgctgaagaagctgtttgctttcggcataatcggccagctgctccgtatatgttttgaatgacatggttttcggagggagtttgatttcctgtccagaggcggcctgctcataagcagaagccaagtcctccaataaaatccgccatgatatcccgtcgacagcgagatgatggaccgtcagaaacaagtaatcttctgcttcagagcggaacagtcccgcctgtaccagcggcccgttctccaaatccatgtttctctgaagctctgcgacgcggcgttttataaaacgttccttctcatgctcatcgccttccgtttctaatatggtcaggttgtaaagctgctcatctgcgaggtcagccggtctgttgaagaggagaagacctttctcttcgtcttttttgcagacaaggcgcaaagcatcatgatgaacggtaatggcttttaacgttttcctgagagcctcttcatctattgaatttgttctcgtcagcatgacggactggttaaaatgatttgcttccttcatgtcttgtgtgaagaaccatttgtgaaccggcgaccacttcacttctccttctgcaggagcttggctgaccggctgccgctctgtacggacataaggcgccagctctctaattgtcggccggctgaaaatatcttttacggcgatctgttttcctgcctgatgtaatcgggctgatacttgcagggctttgatggaatcgccgcccagttcaaaaaatgattgatccgcggcaatgttttcagttccgagcacttcgctccaaatcgcggaaagctctttttccatgtcgctttcaggctccgtaaatgcccgtccggtgtgcgcttttttccgcggctcaggaagcgcgcggcggtcaagcttcccgttcggtgtgacaggcagggcttcaagtgtttcaaagaacgccggcaccatataagcgggcatttcatttctgagcgcctgctgcacggtttcactttctgttccttcttctgtcacgatataagcgcatagttccgtttggcctgctgatgcggtatgagcggtgacggctgcttctttgacaccttttatgcctgttaaggccgattcaatttctttcagttccacccggtagcctctgattttgacttgctcgtccattcggccgatatattgcagcgtgccgtccggcagccattttgccagatcgcctgtgcggtacatgcgccggttcttctggaacgggtcttggacaaaggcttgggccgtttgcttaggaagattgcggtaccctcttgcaaggccggaacccgaaatgcaaagttctcccgttacaccgatcggctgcgggtgatccccgtttaaaatataaacgtgtgaatgctcaatcgtccggccgatcgtaatgttctcactttgttctatatgtcttgccgctgtagtggcgacgctgttttccgtcgggccgtactcattggcaagctccgtgtgaggacaaactgataaactgcggctgataatgttttggtcgacagcttctccagctaatgtgacaattctgagagactctgcatcccccggctccagtacgtcaagcagtgtacggtacagtacgggaacaatgatcatatgagtgatgcggtaagatgcaagatagtgtttaatggcaagaatatctcttgcttcatcttcggctaaaacggccgctttcgcaccggaaatcagcggtgtgaacatacttgttacaaaaccgtcaaatgaaaatgaaaaaagctgaagaaccgtatctttctcattcagatcataaaatccgcttcgccattgaagggtttggctgacggaacgatgttcgaccataacccctttcggcctgcctgtcgtcccggacgtgtaaatgatgtaagccaaatcttccggtgctgataatggctgaaccggtgatgcgtcttgttcttggatatcctccagtgcgagcacttcacctttaaaatgatcaggcacttgatctattgcgccgtgtacggtaaggagaagcgctgtgccgctgtctgaaatgatatattgcttgcgttcctccgggtattcaggatctatcggaacgtaggcgcccccggctttccaaaccccgaagactgcggcgacttgttccggtgatcttggtatcacaatgccgacggcggcattcggtccgatctgccgtttttgcagagctctggcgattttattcgaccattcatctaattctttatatgtgaccaacgtttccccgctgataagggctgccgcatccggtgtttttcgcgcctgagtgatgaacagttcatgaactgttttttcaggcagctgtttatccgtcatgccgttaaagtccgaaagaattcggtcccgttccgcagcagtcagcatgctgatcgcttgtatagaagtttccggttcacggacaatgtgttcaagcatcgtcataaagtgggaagcccagcgctgcatcgtttctttccggaataaagacgccgcatattcaaacagaaaatgaatctgtcccccgccttcagaagcctgcaaagtgacatcaaatttggaaaccggacgggacacgtccgcaggctgaatatgcaaaccgtccaacagcaattcctcatgttccatattctgaacgacaagcatggcatcaaatagcggattacggctcatgtcccgctgcacgccgagccgttccacaagctcttcaaacgggtagtcctgatgctcatacgcctcaagcgccgcctggcggacttccgccaaataatcggtaaaccgtttgtctcctttcggctccgttctgatggcaagcgtgttgacgaacatgccgagaatcggttcaaggtctttgtgcgggcgcccggcaatcggcgatccgacgatgatgtcttcctgcccgctcaatctcgcgagtaacgtattgtacgcggcgagaagcaccatatacaaagtggagccgtgatcccgggcgatgcggtgaaggccggatgccgtttcagcgtcaagcgtgcacgatactttcccgcccgcaaagcttctgaccgccggacggggcttgtcagccggaagctcaagcaccggaagctctccttcaagtcgcttcagccaataggcttcctgcttctggtacccttctttctcctgaaacgaccgctgccagacggcatagtctttatattgaaggcgcatcggcgcaagcgaacggcctgcgtacagctcgccgaattctttaatcaaggtgttgacggacacaccgtcagaaattatatgatgcatatccgttaataaaagatggcgttcatccgattctttcacgagagccgcacggaagagcggcgcttcttccagacaaaacggccggacgaatgcgtcagctgactcggcctcatcgagctgaaacggtacgctgtcatggatgcgctgcaccggttcgccgtcaggccccgtttcaaaggacgttctgagcgactcgtgccgctccacaagctcccggaacgtctcctccagccggacacggtcaagcgtgcccgtcagttccagcacagccggcatattgtagccgacaccgccgtcttcaagctgttggagcacatacatccgtttctgcgctgaagacaccgggtaggtgtcctgttttttcgcaggctgaatcgcttcatacgggctctcttccaagtcctgaataaccgaagcgagctcttccaccgtcggccgggcgaagatgtcctgtaacggcacctgaacaccgaactctttggcgatgcgggagacgagagccgtcgcttttaacgaatggccgccccgctcaaaaaagtgatcccggatgccgacggggccgtttttcagcacctcttcccaaagggcgcaaagcttcatttccgtgacgttccgcggggcggtgtacgcctgtctgtctgccgctccgccgggagccggcagcgcgcggcggtcaagctttccgctcggcgtgaccggccattcgctcatctctataaactgagccggcatcatgtaggccggaaggcgtgccgcaagctctgcccgcacgtcatcgctttttcgtccttcgatataggcgtaaagcgcggtttcgccgtgttcggtccgggcggtgaccgccgcctcacgaatgccgtcgatgcgccggatcgccgcttcgatttcccccggttcaatccggtagccgcggactttcacctgtccgtctgaacgcccgagccattcgacaaggccgtcttctgtccagcgtgcgatatcgcccgtctgatacatgcgttctcccggataaaacggatcaacgacaaagcgctcctccgtcagctcagggcggttcagatagccccgggccacgccggtccctgcgatatacagctctccgatacagcccggcggcagaagctgtttcttttgatttaaaatatacagccgcatgttatgtccggaactgccgatcggaacattgtgaaattcctttccttgcggcaaatcgaagtacgccgcttctaccgtcgcttccgtcggaccgtaggaatttgtcaattccgttcccggcagaaggtcataaaaacgggaaaccaagtgcgggcccaattgttcgcccccggcaaaaaccctttttaagcaggtctttttgatcggctgttttctggaatttatatattccaagaaagcatgaagcatggatggcacaaaatgagctgccgtgatgcggtttttctccaatgcgttcagtatcatttcagggtctttctcgccgccttgcggaaggagaaaaacagaagctcccgcgatcggccaccaaaacagctcccaaatcgaagcatcgaaagagtatgatgttttatgcaaaatggtgtcggaatcctttaatccataacgcgcttgcagcgagtataaaaagtttacggctgactgatgttcaacctgcacgccttttgggcgtcccgtagaaccggatgtatagatgatataagccaatgaatcaggctttaccggaacattggggttggccgcagcttccgggtttcctgtttgtccgcttttcagagagatcgtttctcccttaaaaagatctggtgcgaaaagttctggttctgccagtaagaatttcacgccgctgtctttcagtaaaaagcgaatccgctcttccgggtaatccggatcaatcggcagatatgcaccgcctgcttttaagacagcgtaaatgccgatcagcatgtcaggagaacgccggcccataatggcagttttatcctccagccttatcccccgtttgatcagccggtgcgcaagctcattcgctctttcgttcagttcctgatacgtaatcgaaatctcatcagttaaaatcgccggacggtccggcgttttttccgcctgttgttccagcagctcatgaaggggctgatgaagcggaaacgctgttttctgcaaggggctgaaattttgaagcagagacacttcttctttttctgacaaaacagaaatatcgtctaattccaaacccggatcagctgcggcgttttcagcaagtgtcgtgaaaaattccgcccatttttgaatcgtttttctctcaaacaaatcagtgctgtattcaaactggcagtacaattcaccggcgttttcggagatgtacagcgataagtcaaatttagaaatcggcaggctgacgtctgccggctgcagttcaagtccggctgccctaagcttctgctgttccatattttgcagcgcaaatgttgtgtcaaacagcggatttcgggacatgtcccgcggcacaccgagcttatcgacgagctcttctaacgggtaatcctgatgctcgtaagcctcaagcgctgtttggcgaatttcctttaaatattctttgaacgtcatgcttccgtcgggacgcgtcctgaaagcgagcgtattgacaaacatgcccagaacggcgtcaaggtcggcatgaggccttcctgcaatcggagacccgacaatcatatcttcctgtccgcttaaacgggctaacagaaccgtgtacacaccgagcagcgtcatataaagtgtgcatttgttttctttcgccagctttttcaactgcgctgtatgtttttcgctgatgacaaatgacacccggtcaccggaaaagctccgcaccgggggacgcggcttatcagccggcaattcaagcacgggaatctccccggcaagccggttcagccagtactcctcttgtttccgatatgcggcgcccgccttaaatgattgctgccagacggcataatctttgtattgaatccgtaacggcggcagacttctctcagcatacagctcactgaattcacgtatcaaaagattgacggatacgccgtctgaaataatatgatgcatgtcagctaaaagcagatgccggtctttttctatttggacaaatcccgcccggaaaagaggcgctttgccgagatcgaacggccggataaacgcttcggctgattgttcttttgtaaatgcaaacggcacttcgtcatgaatcctctgcacaggccggccgtttttttcttcaaaggacgttctgagcggttcatgccgccggatcagctccttgaacacggcttccatcctgtctcggtcaaacggccccttcacctctaaaacggctggaatgttatagctgacaccgccattttcaagctggtgaaggacatacatccgtttttgagcggatgagacaggataagttccttttgcttctgtcttttctatggatgcgaacggattctcttctgcttcaccgatgattttggcgagttcttctacagtcggatagctgaagacatcactcagcgggatttgcacgctgcactctttagctatttttgcaacgagtgccgtcgcctttaatgaatggccgccaagctcgaaaaagtgatcgtgaacgccgatcgggccggtttgaagcacttcttcccatatgcgggtaagcttcagctcggtcacattccggggagctgtatatcgacggcccgctgcgtacgccgaagcttccggaagggcccgctgatcgactttaccgttcgcagtgagcggaatcgcgtcaatgaaagcccatttgaccggaatcatataatcaggcagctctttggccaaatcacttcgcagctgagaaggatcagtcgcttgtgagacgctgcagtaggcgcataattcattttcgcccgactcattcgtttgaatcagcacggcagcttctttcacggcatgatgatttgccagaacggtttcaatttctttcggttcaatccggtaccctctgatcttcacttgatcatctgtccggccgatgtattccatttggccgtccgcacgcagtcttgccaaatctccggtccggtacatgacggcgccctttctgaacggatccggcaaaaatttctcttcggtcagcgccggattgttcacatagcctcttcctgtattcgctccggaaatatacaattctcccgcaattccgagaggctgaagctgtctgtttttgctgagaatatacatcttattatgatggatcggtttcccgatcggcggatgttcaggtatgtcatctcccgcagaaatcgtatacgttgaaaccacatgggtttctgacgggccgtaatgattatgcagctgcataccgtgtaaacggagcgtctgcctgaacaaacgtgagatagtcagctgctccccggccgtaatgacatgcttcacacagcggggaaaagactgtgcataaccttcttcattgaaaagcatcttgacaaacgcagtcgggaaaaacaccacttccgttttgtgctgatcgataaacgaatacagctgagaaacatcccgtttgattgattcgggcacgatacaaagggtgccgccgctcaagagtactgaaaataactcctgatagcagacgtcaaacgccaaagatgcgtactgcagcacatttgtgcaaaaatcaatgcctgtgttcgtcaattggtcagaaagaaggttggccatatttttatgttcgagcagcacgcccttcggtttccctgtcgtaccggatgtataaatcatataaaggaggtcgtccgccgtattaatggattgcacattgcttccgtccgcttccgtcccggcctcttctatatatgtaacctgcagcgtttgttccgcggggagtgactgatgccgctctgttacaacatggatgcagccgctgttttcaataacatatcggatacgctcctttggactgcccggatctatcggaacaaaggcgccgcccgcttttaaaataccgagaacggccgccgctaaagaaggagaacggccgagcatgacgcctaccggctcctcccgctttaatccgcgtttttgcagcagacgggccagcttattagccgattcattcagctctttgtacgtcactgacccgccttcataccggatcgcgatttgatccggcgtttgtgcggcctgccgttcaaacatcgcatgaatcgtgtcatactcaggcttttcagtctcttcagaaatcggcgcaagcagctgctctttttcctcaggagtgatgattacaagcttatccggcgtgatatcaggtttgtcgagaatctgggaaacgatatgtgtcaaatgacctttgatattttcgataaattggcggtcatacatgcttgaatcgtatctcattttcaagtgaatctcgtcacccggcgccaccatcaggtaaaaactgtaattggtttcgtcttccatgctgaaatcatggatgtgaaaaaggtctttcgtgtcccccttgctgttcagtacatcaagctcctgttcaaccggataattctcaaagacgagaatatggtcaattaagccttgttttacctgtgaattcgcctgtatatcataaagcggatgatagctgtatgcctgtcctttcaaagcgtccttttgcacgtttttgatcagcttttgaaacggaatgtccgccccgctgatccggacaggcacggtattaatgaacaggccgatcattcgctcgatgcctttgatttcagacggccttccggaaataacagaaccaaaaaccgcatcttctgtctggttatacgcctgaagcaaaatgccccagagcgtgtgaaaaatggtgctcagcgtgacctcttctttcacggccagatctttcagcttagctgtgtcctcttttgaaaaggaaaacgtcacttcctcttggctgctttcgccggcttttttctgcttcggcagaacagtctgctgctcaaagccttcaaggtatcgctcccagtacgaagcggctttttctttatcttgctccatcagccacttgatgtaggtcccgtacggcacagcgggctcaagcgttaacggtgtccggcggagccgcgaggcgtatatctggaagaactctttcagcacgattccgagacaccagccatccataataatgtgatgaaaactccatatgcacgtatattcacattcaccggtttgaagcagcgtcacccgcatcagcatgtctttttgcaggtgaaatcctttctttcggtctcttcgtttggcttcttcaatatgcttgatttgatcagccttgtttaaattggtgagattttcctcaatgatgctgacgttccgctcttttaatacgacctgctgcggcactgacacgttctggctgataaagatcgttctgaaaatatcatgtctttcgaaaagggcatgaacgctctcttcaaacacgcgggtgtcaaccttccccgttattgaaaaggaggcctgctcggcgtaagcctgtgattccttttgcaggagggaatgaaaaagcattccttcctgcatataagacagcggataaatatcctgaattgcattcttttttgtcatgttataatctccccgtcgcctttttctacagttcctcgacaaaactcgctatgctgtccaaatcatcagatgttaacgttttgctgctaaaatcactaacggttttttctgcttcctctttgcctgtgcagtgcgccataatatcacgcaaatattgctgtaaggtttgcagcagctgttccatcgtttctttgcggaagcggctcggcggatagctcaaactgaagtgcagtttatgttgagcggccatcgcgctcatttccaccgcttgttcccgctgccatgtcggcgtgatgtcgtgcccgctcgcaagaccggataaactgaatgtgggctgatcttctgtatcattgaattgccctaaatagttaaaactgatttcaggcgcttgtctgaagcggattgttttttgttcaggcggtgtcatgtattttaaaatgccgtagcctattcctttatccggtattcttccgagtgtgtctttgaccgtttttacagccgttccaagctcagcgcctgctgtgttcaagtcaatgagcaccgggtacatggaggtaaaccagcctacggtgcggctgatgtcgagctccggcatgatgtgctctctcccgtgcccttccatcgcgatgcgcagtctgccgccccctgtccagtcccgtaaagccaaagctgcggcagtcagaagaacatcttgcgtatcggtatggtaggcccggttgacctgctgaagcaaaacggacgtttcttcttctgtaagcgtaaagcttaccgtttgccgaatgctgtcggctcccgtctgatactgcggtttttcataaggaagtccggcggctgtttcttcttcaataaaacgccaatattcttcttcacgcatcagcttgctgctttttgcgtattctgaaagccttacggcgtattgcttaaacgaatcggtctttggcggaagctggaccggctgaccttttacggcttgtgtgtaagcggcagataaatcctccagcagaatacgccatgacactccgtcaaccgccaggtgatgtacggtgatgaataaataatcccctgaccgggttttgaaccagccggcttttaataacggtcctttttcaatatccatccgctgttggagcgcagccacttcatcttctatttctctttcccaagtatctgtctcagacagatcccaaatgtccaagctgtacagttcatctttttgaataccgtgattgatttgtctgatactttcgttttctgcactgacggtgatccggagtgcatcatgatgaatgacaagatgctccaaggcttgtttgagcggctgtttatgcaatgcgtcagagctgaacatcatgacggactgattgaaatgatttctgttttccatccgctgtgataaaaaccagtgctgaacgggtgtccaaggtatgtctccttccaccggttgctgatcgatgactctttccgctttccggataagaggcgcgagttccttaatggacggatgccggaataagtcacttgccgtcattttccacccatagcgtccgagccgtgcggcaacttggagcgctttgattgaatcgccgcccaactcaaaaaatgaatcctcaatcccgacttgttttgtgccgagcacttcctgccagatcacggaaagctgttcttcaagctcattgcggggagctgtgtacgcggtttgaagcgcgagctccggttcgggcagatttttccgatccaatttaccgttcggcgtaagcggcagcttctcaagttccatcatataggccgggaccatgtaattcggcagttgcttagaaagtgaagaacgcactttttctgtatccatgtccgcctgcagactcatatatgcgatcagttctttattgccggactgcccggttctgactgacacggcagcttctttcacgccgtccaggctccttagtgcggcttcaatctctcccagctcgacccgataaccgcggattttcacttgatcatccatccgtccggcatattcaatcgttccgtccggcagccagcgggctaaatccccggtgcggtacatccgttctccgggaacaaaaggattagggacaaatttttcttccgtcagctcagggcggccgaaatatcctcttgccacaccgtctccgcctgtgcataattcaccgatgacgccgatcggctgcggtgttcccctgctgtttatgatatatgcagttgaatttccgacagggcggccgatcgggattgaatgatcgtatgattgttcaatcaaaaagcaagtcgagaacgtcgtgttttcagtcggtccgtatccattccatattgaaagatgcggcagcgttttccgaacccggtttacatgacttggggacagtgcttccccgccgataatcaatcgggataatccggaaaacacgtgttcattttgttctgatagatgattgaacaaagacgatgtcagccacagtgtcgtaatgccgttttgctgtataaatgtttccagaacatcagagtcgagataggtttcctggtcacttacatataaagaagcaccgtttaaaagcggaccgaatatttcaaatgtcgttacatcaaatcctaatgatgaagtaaacaacagtctgtctttcggcgtaaaatcaatataattgctgtttttcacaagacggatcacacttcgctgttcaatcatgacgccttttggcgcacctgttgacccggatgtataaatcatgtaggccaatgattcaggtccgccgagcggttcgggattttccgaacttaagccggcctttgtttgaatatcctctatgaataaacgttttccggaaagcggcagaccgtcaagtttatcagattggagaagaatatcagctttacagtctttaagcatccattcagcccgttcccgaggcacatcgtcaccgataggcaagtaggcgcctcccgcttttaatattccgaggattccggaagcaagctctgttgtacgtccggttaataaggcgacaacactttccggaccgacgccatttgatcggagagccgccgctattctattagcccgttcgttcagctcacggtatgtcaagatttgtccatcatatacaactgcccgggcatcgggggtttcttcagcctgccgctcaaataaacggctgatggtttcgtgtcttgggtaatcgcttttcgtctgattaaactgataaataacgcgatttgtttcagcatcatccagtacgtgaatgtcaccaagcggtattgtttggtcttcaattacttttgtaagaatacgggtaaaataagaaagccatttttcgattgtctgtttttgatagatatctgtattgaattcaaaatcaaagctgatggaaccgtcagacccttctgccgcgtaaagcgtggcatcaaactttgcggttttatgacctgcatccgcggcttgagtcaaatgcagctcatttaaattcagggattcacgctccatattttggagcacaaacatcacgtcaaacagcggattacggctcatgtcccgctgcacgccgagccgctccacaagctcttcaaacgggtagtcctgatgttcatacgcctcaagcgccgcctggcggacttccgccaaataatcggtaagccgtttgtctcctttcggctccgttctgatggccagcgtgttgacgaacaccccgagaatcggttcaaggtctttgtgcgggcgcccggcaatcggcgatccgacgatgatgtcttcctgcccgctcaatcgcgcgagcagcgtattgtacgcggcgagaagcaccatatacaaagtggagccgtgatcccgggcgatgcggtgaaggccggatgccgtgtcagcgtcaagcgtgcacgatacgctgccgcccgcaaagcttctgaccgccggacggggcttgtcagccggaagttcaagcaccggaagctctccttcaagccgcttcagccaataggcttcctgcttctgatatccttctttctcctgaaacgaccgctgccagacggcatagtctttatattgaaggcgcatcggcgcaagcgaacggcctgcgtacagctcgccgaattcttttatcaaggtgttgacggacacaccgtcagaaataatatgatgcatatccgttaataaaagatggtgttcttccgattctttcacgagggccgcacggaagagcggcgcttcctccagacaaaacggccggacgaatgcgtcagctgactcggcctcatcgagctgaaacggcacgctgtcatggatgcgctgcaccggttcgccgtcaggccccgtttcaaaggacgttctgagcgactcgtgccgctccacaagctgccggaacgtctcctccagccggacacggtcaagcgggcccgtcagttccagcacagccggcatattgtagccgacaccgccgtcttcaagctgttggagcacatacatccgtttctgcgctgaagacaccgggtaggtatcttgtgtttgcgcaggctgaatcgcttcatacgagctttcttccaagtcctgaataaccgaagcgagctcttccaccgtcggccgggcgaagatgtcctgtaacggcacctgaacaccgaactctttggcgatgcgggagacgagagccgtcgcttttaacgaatggccgccccgctcaaaaaagtgatcccggatgccgacggggccgtttttcagcacctcttcccaaagggcgcaaagcttcatttccgtgacgttccgcggggcagtgtacgcctgtctgtctgccgatccgccgggagccggcagcgcgcggcggtcaagctttccgcttggcgtgaccggccattcgctcatctctataaactgagccggcatcatgtaggccggaaggcgtgtcgcaagctccgcccgcacgtcatcgctttttcgtccttcaatataggcgtaaagcgcggtttcgccgtgttcggtccgggcggtgaccgccgcctcacgaatgccgtcgatgtgccggatcgccgcttcgatttcccccggttcaatccggtagccgcggactttcacctgtccgtctgaacgaccgagccattcgacaaggccgtcttctgtccagcgtgcgatatcgcccgtctgatacatgcgttctcccggataaaacggatcaacgacaaagcgctcctccgtcagctcagggcggttcagatagccccgggccacgccggtccccgcgatgtacagctctcctgccacgcccgcaggctggatggttcctccgctatctaatacatacagacgggcacccggaacgggttttccgatcggaagccttgtccgtccgctgtcccgttttcggtcacagacgtaaaacgccgcatcaaccgtcgcttccgtcggtccatagccgtgaataagcatggtctccggcagaagatcggcaaaccgggcagccgtaagcggggaaagagcttcccctccggcgaacacgcgtgtcagtgttctgccgaggcgtgttcttgtttccgcaggctctgtttccagcgcgtctaaaaagctgttgaccatcgccggaataaaatgcgcggtcgtcaccttttctgaggcaaacgcttcaatcatccgcacaggatctttctcccagccggccggaagcagatacacggaggcgccggacatcgtccaccaaaacaattgccagatggaggcgtcgaatgaaaaggatgatttcagcacgataatatcctcttccgttaacggaaactgcccttgcatccctgataaaaaggcggcggcttgacggtgttcaacagccactcccttcggtgttcccgtcgaaccggacgtataaatgatataagcgagcgaatcagcatccgcttcttcagagacagcccctgtctccgtctcatttgtcagagaagaaagagacacttctagcgtttcaccggaaaaaccggaaacggataaccccggctgtgcaagcaggagacaagcgccgctgtcctcaagcatatatcgcagcctgtcctcaggatactccgggtcaagcggcacgtaggcgccgcccgcttttaacacggcaagcactgaaaccgccatctccggcgagcgttcagcgagtacgccgaccatgctttctttgcggacgcctttttgtcggagccggacggcgagcctgtccgtgtactggtcaagctcagcgtacgtcagcataccgcccggaaaacggagcgccggacgatgcggcgaaagcgcggcgcggcgggcaaacagcccgtgaagcgtcggagccggcggttcaaccgcttctgtatggttaaatgcatccatcatacttctggcttcacacgcatccagcaatgcgatctcggaagcgccgatttcagggtcggaaatgactgagttcaccatatgccgtaaaaatgtttcgatattcttcataaaaacatcgtcgtatataccggtatcaaattttaagcggatataaagagaattgcccggaatcacctttatgctgcatccgtagtttgtgacttcttccatcgtaaaatcctctaccgcaaaatcaaatgaaccggcctgactcacattttcaatttcacgctgggccggcacattttcaaacacgataatgtggtcaaacagcgcttgcttcagagggctttgcgcctgaatgtcatacagcggataatagctgtacgcttctgcttgcagcgtctcctgctgcaaatgcctgacaagctccagaaaagaaaatgaaccgcttttcacccgtacgggaatcgtattgataaacagtcccaccattttttccacgcctgcgagatccgacggccggccggaaacgacagaaccgaaaacggcatcatcacagcggctgacacgctgcagcaaaatgccccacagtgcctggaacactgtattcagcgttgctcccgcccttgccgcaatgttcttcagctcatttgtctgctcttcagaaatggtgaaaaccgcctgctcaagttcgccgtttggttccgcggattttttcggaagagacgccgtttgctcaagatcggcaagtctcgttttccaaaaaatctcggcttctttacgatcctgcttcatgagccatttaatatacttcccatatggctgaacgggctcgaggaacggaagccgttcgtctccgagagattgatagatcatcagaaattccttcatgacaattccgaagcaccagccatccatgacaatatgatgatggctccatatacaaacatagcgttcaggcgcttttttcaaaatggagactctcatgagagggtctgattgcaaatcaaagcctttatctttatcttcttttctaaaccggtcggcatatttgtcttgtgccttctcgtccaaatgagaaatatcatgaaactgaacgcggctcggcctgtttttcaacacgacttggcggggctttgccacattcttgtgaataaatgtcgtacggaaaatatcgtatcgttcaaaaacagtgtctatacttttttggaaccgttcccggtcaagctgtccgctgatcgtaaacaccgcttgttcgaagtaggctcttgagtcatgatccaacagagaatgaaaaagcatgccctcctgcataaaagacaaaggatatatatcttgtatttccggttgctgccccattgcgccactccttttctatagtttgttgacggctcccataatgtcactcagatcttccagcgttaactcctcgtcactgaaatcagcggcgctccattcacgctcctctttgcctgtgcaatgcgtgataatctgcttgagaaaggtatgaaaatatcccgtcaaaacttcaatcgtttctttttgatactgaaaacggttgtacacgacatgcatgctgagacattccgacgatacggagccgctgatatcaagtgtgtacggacgttcccagtctgggctgacttcatttcccgcttttacgggagaaacaccgaagccgctggaacggatttcccggtcaaactgtcccagatagttaaaactgatttcaggagaatcagattcagtctctccccagagtttgcttatatatttcagcaccccgtatcccgctcctttatgcggtatgcggcgcatcatgtcttttgtccgcttaatgtgatagccgagacgctcgccgtcatcaggctgatcttgaaaacttgcgtcaaccaataccggataaattgacgtaaaccagccgatggttctgctgatatcaagatgctccaggtgctcttcccttccgtggccttccatgctgattttgaatgtctcgtttccggtccatctgttcagcgctaggcttaacgcggcaagcaataattcgcccgtctctgttgtgtatgctctgttcgcttccgttaacagctgctcggtctcctgttttgtcaatgtaacggtcatcacatctgtatctttcagaagattggaagagatgcgggcatctttcggaagcggtttgaccgccgctttttctctttcggaccagtagtctgcttcctgtaacagccggcggctttttgcataatcagagatttgcttcgcgtaagtctgataggaatcggtttttgccggaagcgcggcttcttttccttcgagcgcctgcctgtagcacgcggtgagatcttcaaataaaatccgccatgacactccgtcaatgacaaggtgatgaatggaaagcagcagatgatcgccatcattagcgtgaaataaaccgacagctacgagcggacccgtctccagccgaatggaagtttgaatgcgggcggccgcctgttcaattgcggcgtgttcctcttgtaataaccctttccctctcacgtcatgcgtttcaaatgtaaagagttcttcttcagaaaggttatccgctctgttatattgaatcactgatccgttttgcgtgccgcataccatccgtaatgcgtcatgatgaaccgcgagctgtgccagcgcttttctcatagcagattcattgatcctgtccgcactgctgagcataacggactgattaaaatgatcatgcggcaatgattgcgaaaagaaccagtgctggatcggcgtcagcggcacgtctcccgtgacgggagcctgatcaatcacgcggcggactttccggagccgcatcgagacttctcccagtgtctgatgctcgaacagctcgcggacggtcgtttcatagccctgctgtttcagcctcgcacatacttgcagcgctttaatcgaatccccgccgagatggaagaaatgagcattggggccgagtccttcaacacctaagagttcttcccagatgtcagccatcatttcttcagtttcatttctcaggctgatatcatctccaaggctttcatttaattcaggctgcgggagcgccttctcgtccagcttcccattcgccgtcaaaggcagttcatcaagctctatcaagcgggcgggaatcatatattccggcagaaaagctctgagagaggcctgaacctctgcttcttttattttttcattcccgtgtaagaccgcgtatgcgtaaatggagtgctgaccgtgctgatcagcacgtgtgatcacggcggcctctttcacgaaggaaagctcctgcagcgctgattttatttctcccagctcaattctgtggcctctgacttttacttgcgcatctttccgcccgacatattccagctcgccatttgagagtcttttggcaatatcgcccgtccggtagagccgcatgccggtaatgtgcggattcgtgatgaaccgggaggcggttaaatcatccctgtttacatatcccctcgcgacgccttccccgccgatataaagctcacctggaattccgatcggctgcggattcatataggcgtccatgacaaaagcatggagggtttccagcggtctgccgatattgcttttatttctctcaatatcatccatattcagttttttgcatgtgacgtgaaccgtggtttccgtaatgccgtacatattaacaagctctgtctccgggtacttctctttccagcttttcagcatgccgggctggagcgcttctccgccgaaaatgacatatcgaagcttcagcttgtccgcatgcccggcttcttcatgaatgagtccggaaaaagccgtcggcgtttggttcagcaccgttacgccttcactttgcagcagctgccggtacaaatgcggatcacgggcagtttctttcggcacgataactacctttccgccgtataagagcgcgccgaatatttcccagacagaaaaatcaaagcaataggagtggaacagggtccagacgtctccagtgccgaaatcaaacggcagtcctttatgtgtgataaggctgatgacattgcggtgctccgtcataacgcctttcggttttccggttgtgcccgatgtgtaaatcacgtaagccggctgttcaggcgttatcatttctttcgttctgtctgctgaaacggattcaggcttatcgatgtataaaaccggcagcccgtccattccggatatcccaagacccgattgcgtcaacagaacacgcgcgccgctgtcagtcagcataaatgaaatccgctcgtcaggatagtcaggatcaatcggcagataagctcctcccgcttttaaaataccgaaaatcccgatcagcatttcaggagatcgttcggtcataattccgacaatctgtccggagcggatgccgttttccgacagcatatcggcgattcgatccgccttttcattgagctcgcggtaggtgagacgctcatcggacataacggctgcaatttgatccggcattttttccgcctgtgcctcaaataaactgacgatcgtctcatgcctcggatactcagctgtttgattttccgcttgaagaagcatctgccgctcatttgtgtccagcaaatgaatgtcagacagcttccgctcatcatccgatgcgatttgtcctaaaagctctttaaaatgaccggcccaccgttcgatcgtacctttttcaaacaacgcggtactgtattcaaaatgaaaatccagtgagccgtccggccgttcctcggcatgaagcgtcaagtcgaattttgaaatgtcatgtttcactgcatgtgaagaaacggataagcccggaaggttcactttgaaatcatcactgttttgcaaaacgagcatggcatcaaacagcggattgcgattgacttcccggtgtgtatcaagcttttgggcaagttcttcaaacgggaagtcctgatgttcggctgcgccgagggcgagcattttcacctcttctaaataagcgcggaatgttttatcccctttcggcctgcttctcattgccacggtatttacaaacatgccgatgaccccatcaagctcagcgcggcttctgccggccgcaggtgaaccgacgacaatgtcctcctgcccgctcaatttagaaaggaacaaggagtagcctgccaaaagaatcatatacagtgtcgaacccgtctcatccatgagccggcgcaaattctccgccgtttctttttgtaggcgcgttcgaacaacggacccgctgaaatcaggaagctgcgggcgctttttatcgagcggcagatcaagaaggggaatattttccccgatcgcatccagccaataccgctcatgtcttttgaattcttcagcggcgaaccgctcatgctgccagacggaaaaatctttgtactgaagttttaacggccgcagctcttttcctctgtacaaatccgtcaattcttggatcagaacgctcattgacacaccgtctgcaataagatgatgcatatcaagcagcagaaaatgacgttcttcagtggctttggctaaagtcactctcaaaagcggcgctttttccacgtcaaacggtttgacgaaagtttccatcgcctcttgaagaagtgtcccggatggcatgtgaatctctgtgagatcgagatcgacatgtgaatgtacgtgctgcatcggctccccgtttcgtaaaacaaatgatgtccgtaacgcttcatgcctttgtaacagcgctgaaaaggcttcgtgcagacgatcacggttgagtctgccgctcagttccagacaagcgggcatatgatagcccgtactgtccgccgcaagctgatgaagggcataaagccttttttgcgcaaaagatagcgggtacaagtcctttgcctccgcaggcgtgatttctgcatattctcctcttttcctctgttctaggaagcgggccatgctctcgatggtcggatgttcaaaaacatggcggacggcaagttcaatttgcagccgtttatgtatctttgaaacaagcgacgcggctttcagcgactgtccgccgatttggaagaaatcatctctcatactgatgtgttcccgtttcagcacttcttgccaaatagacagcagctcagtctcaagcattgtgcgcggagcttgataatcaccggttctctcggcttctttcggctcaggaagtgcggcccggtcaagttttccgctcacagacagcggcatttccgtcaatttggtaaagcttcccgggatcatataagcaggtaatctcccggccaattcggcatgaggatcaaatgtcacacccgcgttttccagtacggcataagctgcaagctcctgttccccgtccgccgttttgcgcacgatgactgccgcctcttttaccccggacagacttctgagtgccgtttcgatttctcctaattcaattctgtaacctcttaccttcacctgatcgtcaaagcgtcccatatattcaatcgttccgtccggtaaaaatcgggctgcatctcccgttctgtacagccgttcacctttacgaaacggatgaggggtaaagactttgtccgtcagctctttttgctgaaaatatccgtccgccagaccttttccggaaatacacagttcaccgacggctccgaccggttgcagccgatctccgtgcatcatatagacagaagtgttggcaatcgggcgcccgatcgtaatccggctgcttttttgcaggttgcgcagaatcgtcgtggccacactgttttccgtcgggccgtattcattcagcagctcggcattcgggcatatgttgcggctcgcttccacgatatcaggagtggccgcttccccggcaaatgtcaccgcccgaagcgtctgcgcatcctttttcgtcagcgaatcaagcagaacgcgatacagagacggaacgatcagaagatggcttaccccgtggcgggcgattttctgttttattgaaaggacgtctttcgcatcatcttcatcagttaacagtacacaggcgcccgacagaagcggagtgaaaagactcgttaatgacccgtcaaatacgtatgaaaaaagatgaagcgctatgtctccttctgtcatcccgtattcttcacgccgccattgcaatgtattgctgatcgctttgtgttgtacaagcacccctttcggccggcctgtcgttccggaagtgtaaatgacatacgcccaatttccgctgtcagacaccggcggaagcggtgcagtctgctgggaaaccgtttcctccatgatgacgacgctccccttgaaatgcggcggaatgagggggagcaggtctttttcagtcaggagcagtgaggcttcactgtctctcagtaaaaatgaaatccgttcaggcggaaattccgcatcaatcggcatataggcgctgcccgacttccaaattccgagcagagcggcaaccgtactcattgatcggcgcagcataacagcggtgatctgatctgaacgggcgcctttttcccttaacgcatgggcaatctgatttgcccgctgatttaatttcttgtagctccagcttaccccgttatatctcaacgcctcttggtcaggcgtttttgccgcctgttcttcaaacagcccatgaacggttgtctcagggtacggacggttcgtttcgttaaacgaatgaatcagggcttcttcctccggtggtacgagactgatgcttgataaaagcctgtccggatcttccgttacacaggagatgacctctagaatatgccctttgatccgtttcatgtcttcccgatcgtagatgcccgcattgtagctgaatttcacataaaactcttctcccggaacgatgacgacgttaagatcgtaattggtttcctccgccatcgaaaagttttcaagtgagagcgcatggctttccgtttgctgccagccgtttaccgcagcctgcatctgaaccggataattttcaaaaaccaggatgtgattcaagagatctttttgcaggccgctctcgttttgaatgtcataaagcggataatagctgtgctcttccgcagcgagtgactctttttgcacctttttgagaagagaagaaaaagtcatatcaccagccgcgcgcacccttaccggcacggtattgataaacagtccggccatggattcaatgccgctgatagctgaaggcctgccggaaacaaccgaaccgaagacggcatcttcagtcccgttgtaacgatggagaagcagaccccaaatgcccgtaaatatagtattcagcgtgaccccgatgcctcgggcaatgtctgtcagtttttgtacggtttcaggctcaagggaaaattggaaatgctcagatgcataaccgttttgcgccgtcttattcttcgtttgcggaacggaaacggtttctccgtaatcttccaagcagcgcgaccagaatgctgacgtttcttctttattccggcttcggagccatttgatataagtgctgtaaggagccggactgccgaggtttacaggccgcccgctccggatcgcataatacatgctgaagaaatctttcagtacaaggcccaagctccagccgtccatcataatgtgatgatgagtccaaacgcacgtatggcggttttctcccgtttgaaaaagagtcaggcgcattaaggggcctttttgcagatcaaaccccttatgccggtcggtttccttgaatttgtcaatgatgctttgctgccgttcttccgaataatctgaaatgtcttcagtccgtacggcagtgtcacggcgtgaaaggacaacctgctgcggcccttcaaggtcaggcacttcttttatgaaaatcgttctgaaaatatcataacggctgacaagcatatccagacttttttggaatgtatcaatgcataaatccccgctgactgtaaacgaaatctgctcaacatatgcgtttgatccggaatccagaagcgaatgaaacagcatgccttcctgcatatatgataaagggtaaatatcttgaatttctgtcgcttgtgtcacgaatgccacacacctttttatgaaattaaagtccttttacgagatcttcaatgcttgatagggcttgagcggtcaattctgtatggctgtaatccgttaatgttttttcccgctctttcttgccggaacagtgggcgatgatgtccccgaggtgagtatggaaacgattcatgaagaactcgattgcccccggtgcaaatacatcggtataaacggcttttacctccagttgcccggccgccaccatcgcgttaatatccagatcaaactcgcggatgcgcccggccgctatatcatgctgcggcttgaacggtgacatcttcagcgtcccctcaagaccgtcaaacgcaccgagatagttaaagcttatttctgggtctttataaagaatgtttcgcgaatatctcagcagcccgtagccggttccgtgatgaggaacccgtctcatcatgtcttttaccgtctttatgcggtgcgcggttgtttcccctgagccgtccggcactctcatatccaaaagcaccgggtaaacagatgtaaaccagcccgccgttcttgacatatcaatgtcaggaatatgcccctggcgtccgtgtccttcagtgctgataaggatctgttcggaacccgtccactcatgaagcgtcattccaagcgccgttaaaagcaattcatgaacatccgttccgtacgcctgctgtgtttccatcagcagctgcttcgtgacttcgctgcttaatatccatgatgcagtgcgcgcgttttcctgcaatcgtccggcgttttcatcagttattttcggcagcggcgctgtttcaccagacatcacgctgtcccagtatgcggcttcctccagcaatgctttgctcttggaaatgtcaaaaagctcttcggcatactttatataagaatcgcttttcggcggcagttcgatttgtttgccgtccaatgcctgctgatatgctgtctgcagatcttcaagcaatattctccacgacacgccgtccgtgataaggtgatgaatcgtgatgagcagatggtcggcttctttcagcctgaacactccgagatgaagcagagggccttgatcaaggcgcatagcctgctgtatttctttttcctcagcggctatccgtttttccggctgtgtttcttctgaaagatctatgacgttaagcgtaaagatttcttcatgctgctctgtgattccgcggttatattgaacaacttccccatgctcattttcagtgaaagtcattcgcagcgcatcatgatgttctgtcagcgcgcaaaccgcctgatacagcgcatctatttcgaggctgtcttcactgcacagcatgactgattggttataatgaagctcaaacgcacccggctcctcaaaaaatctctgctggatcggtgtcagcggagcgcttccttctatcgggccctgatcagccgttgcaacagccggcgtgaggtgcttcgcgagttctgcaatcgtcgggaactgaaacaaatcgcggatcgacatgttccagccttctccggcgagtcgggctgacacttgaagcgccttaatggaatctcccccaagctcaaagaaagagtgatgaattcccgctttctgaatatgaagcacatcttcccaaatccggcataacatcgcctgtttttcatcgccgggcgcgacaaatgcctgtgatgaatgtatctcttctgccggcaatgccgatttatcaagtttgccgttcagtgtaaggggcatgctgtctaaaccgataatatgagacggcatcatataagccgggagctcctgcataagagactggcggagtgatgagatatcggcctctttaggaacgacgtatgccgctaatcgtgcttgtccttcggcatctttcatcacggtaacagccgcttctttgacttgatcgtgtttcaaaagcacactttctatttctcccgtctcaattctgtagcctctgatcttcacctgcttatcgatccgccctttaaaacgaagagttccatccggcagccagcaagcctgatctccggttctgtaaagcgtttctcccgtttgtaacgggtcactgaatgcgtcctctgtcagctcaggctgtccccaatatcctttggcgacgccggcgcctccgatatacagctctccgaaaacgccgatcggctggacctgtttgtctttgtttaagacgtacatttgcacattcggaagcggaacaccgatcggcacatcatcttcccgcggctcttcgctcatttcggcttcataatacgaagagtcaattgtcgcttctgttacaccgtagctgttaatgatccgcatttctttcccaaagcgttcatgaagcgtataaaaatcttgcgacttgatcatatctgaaccaagtaccagtatttttacgctttgcagcgcgagtttccggcggtatatatattccataaacggaacaatcagcgcgggtgtcgactccataaacgtgatacggtgctgatcaatgagccgataaagctgctgcggctcaagccggacgtcatccggacaaatgacaagcgttcccccgtttagcagggcgcgtgctagatcccctgaaaatacatcaaatgagaaactcgccatctgcagcactctgaccggtataagatcaagctcataaatcctgcgccatgcaagtgctgcatgcgtaaagctgcgatttctgacttcgactcccttcggcgttcccgttgttcccgaagtatatatgatatatgcggtatcatccggtgacgctgtcggctgaatattctttgcggaaatatcgtattgatcttcatgatcaagctgaatgagaaataaattgtgatccgtcagctgtgaagcaagttctttgtattctgactgcaccatcaagacggatgccgcgctgtcttttaataaatagcgaatccgttcctcaggataatgggagtcaaccggtatatacgctcctcctgatttcatgaccgcaagaacactgacgatcgcttcaatcgaacggtttgctaatatggctgctctttttcccggaccgaatccatttttctgcagtgttcgggcaagacggtttgcccgctcattgagctggaaatagctgatctgttgtgctccttcaataacagcggtctgatgaggcgtttcttctgctttctcttcaaacagctggtgaaacagtttgtgtttttccatgaattcggtttgtgtgttattaaactcaatcagtaacttttgtttttcttcttcatccaaaatgtcagctttcgatagtgtgacttccggttcggcggcaacatggcgcaagagattcagtaagtggcccatccagcgttcaatcgtttctttcataaaaagctcggtgctgaattccatctcaaagcggatgtttccatcggattcagccgctgataaggtcaggtcaaaacttgatacatcatgttcggtatgctttgatcgtgacgccttcagaccggccagatttatctcctcccgctccatattctgaagaataaacatcacatcaaacagcggattgcggctcatgtcccgctgcacgccgagccgctccacaagctcttcaaacgggtagtcctgatgttcatacgcctcaagcgccgcctggcggacttccgccaaataatcggtgaaccgtttgtcccccttcggctccgttctgatggcaagcgtgttgacgaacatcccgagaatcggttcaaggtctttgtgcgggcgcccggcaatcggcgatccgacgatgatgtcttcctgcccgctcaatcgcgcgagcagcgtattgtacgcggcgagaagcaccatatacaaagtggagccgtgatcccgggcgatgcggtgaaggccggatgccgtgtcagcgtcaagcgtgcacgatacgctgccgcccgcaaagcttctgaccgccggacggggcttgtcagccggaagttcaagcaccggaagctctccttcaagccgcttcagccaataggcttcctgcttctgatatccttctttctcctgaaacgaccgctgccagacggcatagtctttatattgaaggcgcatcggcgcaagcgaacggcctgcgtacagctcgccgaattcttttatcaaggtgttgacggacacaccgtcagaaataatatgatgcatatccgttaataaaagatggtgttcttccgattctttcacgagggccgcacggaagagcggcgcttcctccagacaaaacggccggacgaatgcgtcagctgactcggcctcatcgagctgaaacggcacgctgtcatggatgcgctgcaccggttcgccgtcaggccccgtttcaaaggacgttctgagcgactcgtgccgctccacaagctgccggaacgtctcctccagccggacacggtcaagcgggcccgtcagttccagcacagccggcatattgtagccgacaccgccgtcttcaagctgttggagcacatacatccgtttctgcgctgaagacaccgggtaggtatcttgtgtttgcgcaggctgaatcgcttcatacgagctttcttccaagtcctgaataaccgaagcgagctcttccaccgtcggccgggcgaagatgtcctgtaacggcacctgaacaccgaactctttggcgatgcgggagacgagagccgtcgcttttaacgaatggccgccccgctcaaaaaagtgatcccggatgccgacggggccgtttttcagcacctcttcccaaagggcgcaaagcttcatttccgtgacgttccgcggggcagtgtacgcctgtctgtctgccgatccgccgggagccggcagcgcgcggcggtcaagctttccgcttggcgtgaccggccattcgctcatctctataaactgagccggcatcatgtaggccggaaggcgtgtcgcaagctccgcccgcacgtcatcgctttttcgtccttcaatataggcgtaaagcgcggtttcgccgtgttcggtccgggcggtgaccgccgcctcacgaatgccgtcgatgtgccggatcgccgcttcgatttcccccggttcaatccggtagccgcggactttcacctgtccgtctgaacgaccgagccattcgacaaggccgtcttctgtccagcgtgcgatatcgcccgtctgatacatgcgttctcccggataaaacggatcaacgacaaagcgctcctccgtcagctcagggcggttcagatagcccgggccacgccggtccccgcgatgtacagctctcctgccacgcccgcaggctggatggttcctccgctatctaatacatacagacgggcacccggaacgggttttccgatcggaagccttgtccgtccgctgtcccgttttcggtcacagacgtaaaacgccgcatcaaccgtcgcttccgtcggtccatagccgtgaataagcatggtctccggcagaagatcggcaaaccgggcagccgtaagcggggaaagagcttcccctccggcgaacacgcgtgtcagtgttctgccgaggcgtgttcttgtttccgcaggctctgtttccagcgcgtctaaaaagctgttgaccatcgccggaataaaatgcgcggtcgtcaccttttctgaggcaaacgcttcaatcatccgcacaggatctttctcccagccggccggaagcagatacacggaggcgccggacatcgtccaccaaaacaattgccagatggaggcgtcgaatgaaaaggatgatttcagcacgataatatcctcttccgttaacggaaactgcccttgcatccctgataaaaaggcggcggcttgacggtgttcaacagccactcccttcggtgttcccgtcgaaccggacgtataaatgatataagcgagcgaatcagcatccgcttcttcagagacagcccctgtctccgtctcatttgtcagagaagaaagagacacttctagcgtttcaccggaaaaaccggaaacggataaccccggctgtgcaagcaggagacaagcgccgctgtcctcaagcatatatcgcagcctgtcctcaggatactccgggtcaagcggcacgtaggcgccgcccgcttttaacacggcaagcactgaaaccgccatctccggcgagcgttcagcgagtacgccgaccatgctttctttgcggatgcctttttggcggagccgaacggcgagcctgtctgtgtactggtcaagctcagcgtacgtcagcataccgcccggaaaacggagcgccggacgatgcggcgaaagcgcggcgcggcgggcaaacagcccgtgaagcgtcggggccggcggttcagccgtttctgtatggttaaacgcagttaacacccgtttcttttctttttcatccgccatatcaatatgccgaatcagccggtttggatttctaacggcattttcaacgatcgtcagcaaatgagtttgaattcgtttaatcgatgttttagtaaataaagcggattgataatcaaaattcagctcaatcaatcccgtatctgtccgctccttaattaaaatggacagctcatttgccgtatgcccgctgaaaaacatcgccgtttcataatcgaaaccttctgcctgacgccacgcgagaggctggtattgcatcgaaatcccgatgatattttgcaggtcgtgatgaatctgccttaattcattgacaaaaagattgtaaggatatttctggtgccgcataacagacagctgctgttttcctacactgcggacaaaagacacgaactccgcatccggatctgccgtcattctgatcggtagcgtgctgacgaacatgccgagcatatccttttcgagcttggaaccgcggtttccgtaataagtaccgatggcaatatcctttttagccgtcagacggctgatgcatatgtataacgaagccataaacagagagatgatgctgacattatgatctttgcaaaaacgccggattgattgttctaaggagtgggaaagagtgattgtatctcttgaagctgcagtgctttgtctaagatgagaggttcgttccgccagtgaaaggtgttccggaacggttcggtatgtttcagtccaaaatgaacggtctttttgaaaacgggaagactgtaggtattgctgttctttttccatgtagctgagataggaagggctttggtgttcggccaaatcctcgcttcgcatgattttttggtagatttcaatgagctgattgccaagcagattgagcgagatgccgtccataataatatggtgaaattttgaataaagccaaacttcttcgtctgacatgacaagcagagtaaaatgatacagcggtgaatgaaacagcttgaacggaacacgcgtctgtttgtcaatccatgcatcccgctctgattgatcaatatgagtaaaatcaacggtctctaaagaaatcggccgatgcccggccagatacagctggggttctgagccgtccccttccgtcagttgaaacctgagcgaatcattttgcaagatagagaaatctaaagcacggcgcaatacgtcaaagtcgatattccccctgaatttgacgcacgccgcaagattgcagatacttgtgcccggctcgagcagctctgtaaaccagactcttctttgggcgtgagttaaagaataaacagtgttcttcaatggaatccctccatttcaatttaagaggataagaaagtgaaataattacaattaaatttcgacagcatatgactaaatcatccatataagcattattttaaaacatattttagaaatcacaataaaaaattaaattttttctaacattttttagaatatagtatatattcctcacttcacttcttcatttctataatttttataccatgtaaaacagtatgtatgtacactgcaaactggttctaaaacactataataaggaataaaatgtataattaattgcgcttttaaaaaggttttgctttccgaaaagaaattttatgataaaaaatgaaaaatcagtgaacaagtaagaaagtatcatgtaaaaaaaaggaagaatgttgccgatattactttttgaaaagattgattcataatcgcaatataatgttttacagacatcaaaaaagccgaaccctctaaggatccggcccttcttattgatttgccagcacgactgcgattttgtcttcaatgtcttttccgtcatcttcgtcaagcagcccgttttgaagcacggaaaaaataagcgtatctcctgtttttgtgtctgcatagccggcaatcgaactgactgatgttagtgacccggtttttgctttaattttgccctctgccggagtattcttcagccggttccgaagagtgcctcccgtcattctgtcgcttgcaccggcgacagggagcgaacgaaggaaagccgggtaccacttctctttctgaaccgcatacaaaagctctccgatttggccggcggatacgccgttaatatgagaaacgccggatccgtctcttgcaatcaattcatccggattgagcccgaacgatttgagctccgatttcatcacgtccaagcccttttcccagctgccctccccttttttcacttttcccatttccttgatcagaatttcggcgtgcccgttgttgctcagtttcataaacgggatcaataattctgaaagaggcatggatgtccgtgatgtgacaagctgggtgcggtgcggcattcggcctgttctgattttcccttttacagttacaccctgtttagtaagcgcttgtttccataaatctaaagcataggacgacggatcccacactgccgcccattctcttgcctttgccgagccggcaggtatggctccctttatcgtaatcacattgccaccgtgctcccgttcaaccgtcaattctttcttttcatcagaagcgacggtttttacttcatttttcacacgaacgatgtccgtatagggagaaattgaaatgcgcggctttttatcgggctgtttcgccgggctgatttccgcaatcaccgttccggtatcataatcctcatttggggaagcggtaagagctgatacttgcgcgccataatattggccttcatcactccacggaagatcaactgaatacctggtatcgtcataccacgaatcatccccgaccagatctcctttaatgacatggatgcctctggctttgacctgtttagccatcttctcaaaatcagaagccaatagggtcggatcgccttttcccctgagataaaggtttccgcgcagctgttttcctttcacggcgccgtctgcccgtacttctgtcttaaaggtgtaatcttctccgagaacggaaagcgccgcagatgccgtcagcagtttcatcaatgatgcaggcctcagccgcatatcttcccggctgccgaacagcacctcccctgtttttgctgaccggacaatgatgcccgctgaagccccctttaaagcgggttcttcatccagaatgtgttccagctctttttgcaaagtatttttttgttcagccgccttagccgcatcatcaatataaggaacttcggcaatgatcaaaagcagaatcaccgcgcacaagcgtttcacatatgttttcaatgttatcccgcctctttcctattcttcgtcatgcaaaatggtgatcccggatgacgcagccgcttcttcgcccggtttcagaatctgaagccctgtcagtgatgcaggctgattcagattaaatgcatctgtaacggaagtataaggctcaagactgacaaacccctgctttccgtcaccgttatataccacccaatgcttgaaagacgtgtctgcctgatacaaaacggataatttctcattcggatgataaataacagcttcgttattgccgccattccgtccggaagaaagaaaaacatcgtcaaactgtttatttttcaaagacatcccatgacggaacgcttctttatcaggaacatccaataaacggcccgtcggtacgaaacgttcatttaattcccacatgcggtcagccgtcaaaaatagacgggattgctcttcattgaaaacaaatgtggaatgatagcctagcccccaaggaaaagcctccgttcccttattcataatcagcgcccgctgcgtaaacacattgtcttttaatgtataggtcatccggacaatgacatcgtgcggaaattgtttatgaacacggggaatctttgaaagatcaatttctgtttcgactgtcattccatccccctcttctttcgctgctgccgctttccaatgctgattgtgaagaaagccgtgaatatgattatgtttatcctcttcgtttatctcgaattgatacgagcggccgtcaaaacgaaacgtcccgtccgtaatccggttcggcgggaataaaacgggaatgccgtacagcatcggttttttgaggaattcctccgcagtttccggttctctcagaagccgcataccggttcttttatcccgaagcgatatgacatttgatccccactccggcacaatgatgcattcagcctgatcagtctccgcctttatggctgaaactcctaaataagtcgtatgttcaatcgtcataagcacctgccctttccttgttttctagcatgtataggaattccattttctaaactcattttccttctctaaaaaaaacatcgcccgtatgaactgagcgatgtgcggtaaaaccttattgaatcagccgggtaatctgttttttcttccatacaaaccggtaatatccgtattgcagcagcaggctgacgacaaaagccgccggataaccgacccaaatgccgagaatgccgagattcgtataatgagaaagaataaaggccacaggcacttcaattccccaaatcgtaaaaatgctgataatcgtcggccataacaccgtaccgctcgcccgcattgttgctgaaacaatctgagcgtgaccgaaaatcagatagctccaaagggtaatcataatcagattgcgggcaatgcggagtgtatcctgatcggttaaaaacaaagccagtatctgccgggagaaggtgtaaatcagcacaatcaaaaccccgccgatcaaataattcaggccgatgccgactttgatgacctgcttcagccggccgaattgattggcgccaatggattgggcggcaaaaattgaaacggcgataccgaggcttaccgccggcatctgcacataactcgccacttggttgacgaccccgtaagcagccgtcgcgtttgatccgtaatgattgacaaatgaaatgaccgcaatttcagaaagtgatacgagaatcatattgatgcttgacggaataccgagacggagtaaaagcgcgagcagctttttgtccattttaagagaacggagcgcagtccggtcaaatgccaatggatgtttccttttccgcaaataaaccatgagtacgataaatgtcacgatgtttgaaatcacggttgcatacgccgaaccgtaaatgccgaacttcggaagtccgaaaagcccgagaatcaataagggcaagagaccgatgtttatgactgtactgacgattaacgtataaaacggagtctttgaatctcccgttccgcgtaaaaatgtcgtatacgcaaaatataaaaacatcagcggcattgcgcaaaacaaaatacgcgcatatcggacactgacatctattacgttttccggcgttcccatcagccgcagaatatcaagcgtaaacacactgccgacaactgccagaacaacaccgagcataaaggtaaaagtcagtgtagtgccgacaatcgccttcatcctctcttcgtttttcgcgccgtaagcctgcccgatcagaatggaacttcccgaaccgattccgatcgtaaaggagatcagcagaaaaaacagcggaaaaaaagacgatacggcggcaagcgcatcaactccgagccaccttccgacaaataccattccgaccaattggccgacagattgcaatacattgcttaaaagcagcggcactaaaaacagtgacatcgatcgccagacagactggccgcggccttccgctgtttctaaatgatcttgtacttccatatgtaggactccttttttgattttcttccattttattattcagcagacagcttgtaaaaaccttttgttcaatgaaactctttatcttattctcacgtcttacatggaaataaaccataaaaataaaaagtccggaaaatatttctgaaaaggtattgtaatcttatcgtaattattgtaacatttgtaacataagagaaagagattgattgaaggagagattatatcatgaaaaaatggctattattcctcactactattacattgattctgtcattgggcactgcggcgaccgcaaaaaatgcacctaatgaccttacacaaaaacaagcacttcagctggccctgtcagcgagagaacatttctggaacacgatgagcggcggtgcgcttaaatcaaacgcaaactgcacatctgaaccgtttgaatatcaaaatcttcaatacgtctttatgtgcaaagacctcggaacaaaagcgaaagccgtaaaatatctgacacccgcttttacaaagcaagcgattgacaaagggctcaaagattaccacttcactgtaaaagacggcaaattggctgttccgctcggcgacggagataacctcctgaattggaaaaaagcaaaaatgactcttctttctaaaaaaggaagcgttcaaacataccgcttcactgtaccgactcttgacggttcaccgtcagcaaaacgcgatgtaacattcgtaaaagaaaacaacgtttggaaagtcaatcaatttgatgctgtcatataagaaaaagcccgcttgcttacagcgggcttttttcacatcatttccaccaggttcttgcaaaatattaaactcaaaaaccccttgtataacaaggggttttctgtcttgccgacattattaatccgcacctatcttatgtcgaaaacgctctaggagagattcgaactcccgacctgcagtttaggaaactgctgcactatccgctgtgctactagagcctgcttctattatagtaacgctggcggccgtttttttcaagcctacagccctccgaacactttataggcggctctcgtcgtatcttcatctattccgatataacgcattgtaatagacggagaagaatgattcaaaatcctctgcagttcagcaatgtcttttgtcctctgataaaaatgatacccgaacgtctttctaagcgtatgcgtcccgatttcctccaatccgcacgcggcagctgcttcctttaatattctgtatgcctgaatccgggaaatgggcttattcgtccgtttcgatttaaacaaatagtcatcctctttcatgtcttttgtataagcgtatatgtcggccttcaaagactccagtatcagaatttttcttttctttctcgttttgctttcggttgcccacacatggtctttgttccttacatccctcacgcgaagcggcagaacatcagaaatccgcagtgcgctgttcatgccgaaaataaataaaaaataatcacgatcacttttcttcattaaatactgtttgacttcctggatcttctccaaacttcggatcggctgtacgatatgcatcaaaaaaccccttataattggtaaagtaacatattgagcattatgttactattatagccgaaacctgttgaatgataaaggataaagggccttatgtaacataatatacatagtgttacataaggggaataaggcacgcagtttcatcgaagtcttcaaaacatcattttcgacccgatgacgggattttaaatcaacagagactcacggtattaaaaaagaaaaacaacgcccttaaaacgaaatctgagcattcgtttttttgtgagcaaccgaaaaaaatgaaaaaaaaagacacaatatgaaattgtgtcctagtcttcatcttttacatcaatgtcttcaggaagcggctcatttaaaaactcttgaatcatttccttatatttttccagctgttcgagatgggtttgaaattgttccttgttgattaaatattgctgtccgtcatgtacggcccttattttattcgtcaaaacaagattgtgcacatattcttcaggaagactggtaaactcagctgtctctttgatcgttaaatacatggctcacgttcctttcatatgtcatgtgagtgaattctgttttgtttattgtagcttattttttgtctttatgcttgtttcacagctttttctgcccggtttcccatttagcctatttgcgactgattacattcacacagaaactccggctttttgcgcaccggactattccgtttgtcacttgtgaaaacagcacattttacttactctataattgtaagcggaaaacaaaggaggcagactatgaaaaagaaaaagtttatgaatctctgttttatcgttctgctcagtactttgctcacggccggaagcatcccttatcacgctcaggctaagaaacacccgttttcctatgacgactacaaacaggtagatgtcggcaaagacggcatggttgccaccgcccatcctctcgcttcacaaatcggtgccgacgtgctgaaaaaaggaggcaatgcaattgacgccgcggtcgccattcaattcgcattaaacgtaactgaacctatgatgtcgggaatcggcggcggcggatttatgatggtttatgatgcgaagacgaaagacaccaccattatcgacagccgggaacgcgcaccggcaggcgcagcaccggatatgttccttgacgaaaacggcaaagccatccctttctccgaacgcgttactaaagggactgcagtcggtgttccgggaacattaaaaggacttgaaaaagcgctcgacaaatggggcacacgctccatgaaacaactcatcaccccttccattaaacttgcctcaaaaggctttccgatcgattcggttttagctgatgccatctcagattataaaaacaaattatcacacaccgctgcaaaagacgtgtttcttccggacggagaacctctgaaagaaggagacacactcatccaaaaagacttagccaaaacatttacagctattaagtacaaaggcacaaaagcattctatgacggtgcattctccaaaaagcttgcggaaacagtgcaggaattcggcggctcaatgacagaaaaagatatcaaaaacttcaatgtgacgattgacgaaccgatctggggggattaccagggctatcatatcgcaactgctcctcctccaagctcgggcggtgttttcctgttgcaaatgctgaaccttctggatgattttaagctttctcaatatgatatccgttcttggcaaaaatatcagcttctcgcagaaacgatgcatttggcttatgctgaccgcgccgcatttgccggggatccagaattcgtcaacgtccctctcaaaggcctcttgaatccagattatatcaatgcccgcagacagctgatagatattgataaagtcaataaaaaaccgaaagccggcgacccttgggcctatcaggaaggttctgcaaactataaacaagtgaagcagccgactgacaaacaagaaggccaaacgacccacttcacggtaaccgaccgcttcggcaatgtcgtatcttatacgacaacgattgaacagctgttcggttccggcattatggttcccggatacggcgttgtgttgaataatgagttaacagacttcgatgcggtgcctggcggcgcaaatgaagtgcagccgaataaacgtccgctcagcagcatgactccgactattttattcaaaaataacgaacctgtcctgactgtcggctctcccggcggagcaacgattatttcttccgtcctgcaaacgatcctgaacaaagtcgagtacggcatggatctgaaagcggcggtcgaagagccgagaatttacacaaacagcatgacatcctatagatatgaaaaaggagtgccggaagaagcccgcacaaaactgaacgaaatggggcataaattcggcagcagcccggttgatatcggtaatgtgcaaagcatcctgatcgatcgtgaaaacggcacctttaccggagttgccgactcaagccgaaacggagccgcaatcggcgtaaacttgaaacaatataaaaaataactaggcaaaaagcctcgtttctcaagctgagaaatgaggcttttgtttattctgcactgtattcagatgagggtttttcagatgttaacgaggcaagtgaaagcacgccgcacatcgcgatgacaacacccgctgatccgatccatgtcactgacgcaagagacagatgagtgacaacaatgcccccgatgcccgccccggccgccatagccagctgcatcacagactggttgaggccaagtaatacacccgatgattcaggctccatcgttgccaaatgatactgctgagcaggtcctgatgaccaggcggcgaaggaccaaaaaataagcactgccgccgctccgaaagcagaatgtgtgacaaacggcaataacatgagcatgatagcatgaagcgccattccgccggttaatgtcatacgcgcccccatttgtcagcactgaaaccgcctgctttagaaccggcaagactagcaacaccgaaaataagcagcaatgtactcagtattccgctgccgatatgagtgacgttcagtaaatacggagaaaggtacgtatacgcaaccgaatagcctccgagccaaaaaaacgtaatagcaagcccgacagccacctttcgtttcttcaaaagagaaaattgctgaataagcggcaccggtttatctccttttatctcaggcaacgcaaaacgtataataagcatggcaatgattccgattgccgcaattccggcgaaaaccaccttccagccaaaagcttcagacacggttcttccgatcggaacaccgataatgagcgccgccgtaaaccccataatgacggtcgcgagagaacttgcctgttttcccgggggagcgatttttgctgcgatcgtaagcgcggtgaccaccacagttcctgctccaagcgccatgatcacccgggctgccgcaaataagccgtatccctgtacaagaaatgaaatgatatttccgattacaaacaatccaagagcatagatcatgagcttccttctgtccagttttgctgtaagggccatcatgacaggcgttccgattgcataaacaagtgaaaaaatcgtaatcagctgccctgctgctgccacagtaactcccaaggaacctgcaattttatcaagcatcccggatatcacatattcagacgtccccactaaaaagctgataattgccaaaatgtaaatcttccaggtattttgcacctgacacactccttcattgataatttatataaagatatattgtgatatatcgatataaagaattgaacaaacagaaacaaatcgcaatatgtcgatgtgtagtcgaaaaaagaaactgaatccctcttctaaaggattcagccctacatttcgcgctgaaaataatcggccatcgcctttatcgcatcttcatctcttttataataggtgtatttgccaatccgttttgtttggataaggcctgcgcgctgaagaatggaaagatattgagacgccgttgactgtgtcatctgaagcttatcggtgatctggctgacacatactccgatctcattcatatcaatgccatcatgcggtgcgaagtgacggtccggctctttcagccattgtaaaatctcaagccgtgactcattagacaacgctttaaaaacatcaataggtttcatacgctttattatatcgtgattttgcgatatgtcaatgttatttttcttgaatctctattttttgttttgtctctcttatgatccgggaaataaaatcactcacattctcttcaaatgtgttttcccgcccgtattgccttacatgtacagaatggtggcggcactcttgatctcccacaaccgccatatacggtatttttttcatttgtgcttctctgattttatagccgagtttttcatcacgctgatcgagctcagcccggatacccgctttctttttgagaaaaaccggaacgaaaaaaaattggcgtacacagctgtcctgttttctcatcttctgttcgataatgtttttaatccattcagcagttcttcaaacgccgatgttaaaaataaatcactccggtagatgaatgatatattcatattccgaaaatgttcaggaagctcatgaagaaaaagatttttcctgttttgaaaataacggacggctgatgcaggcagaaaggagacccccatccccgcctgcaccgccccaataatggcttccaacgtaccgaattcaatgattttatgtgcgggcactgcctcttctttcagtatgttttttattttgcggcggtgcgaacagcccgcggcaaaatacagaatcggctctcgcagcaagtcttgcaaactgccttcccgcttatttgaaaccaagaccaattcttcttgaaatacagcgacttgctcaagatcttcatattcgaccggtccgtaaacaaaagcgccgtccagctcatagtgtagaacgcgctgcactaaggtatgtgtatcaccggttgacagagacagctgtactttcgggtagcggctgcaatactccgtgaaaaattgagggagatggacggctgccgccgtttcaagagaaccgattcgaagcgggccgttcggatcgcctgcctctcgcgctgttttttgcgcctcatgcagcaattgaaggattctgtctgcgtcttttaataagttttcacctgttggcgtcagcgtcattccccgatttgtgcggtaaaaaagctgtgtttgcaattgccgttccagctgctgaatccggtttgtcacatttgattgaacataatgcaggctttctgccgcctttgaaatacttcctttgcgggcgacagcctgaaaaatctttaagtctccgctttccatctaagggcaccttcttgctatgatttttattgatagccggctatcaattttcatttatttactgcagctgatacagcctgtaaaatttttctcatcaatcataaaggagagaagaatcatgaatgtccttatcatacacgaaaatggctttaatttcaggcaggcacctgacaaaaggccgggaaacggcgaagtaaaaataaagctgaaaacagccggattaaaccatcgtgatttgtttttaatgaaaaaacacgaaaccggaaaccatgaatttattctcggttcagacggcgcgggaatcgtaaccgaaataggacacggcgtccggtctcatttactgaatgcagaagtcatcatcaacccggtactgaattggaagactgttgaggacgtaccagccgtccctgatattttaggcggtccgagcgacggaacattttcaccttatgtcatcgttcctgcggaaaatgccgttttaaaacccgaacacctgacttgggaggaagcgggcgtcctgccgttatcagcattaaccgcttatcgcgccttatttacaaaaggacaattaaaaaaaggcgaacaccttatccttccgggcatcggaagcggcgtggcaacatatgccttattaatggcaaaagctatcggagcgacagtcagcgtcacctcccgcagtgaaaacaaaaaacaaaccgcactgtcatacggtgcagaccgggcgattgacagctacggtgactggaatgaggcgctgaatggcgaaaaagcagatatcatacttgacggtgtaggccccgctttatatcaacactatcttgacattattaaaccgaatggccggatcgtaacattcggcgccagttcaggcgatcagctcggatttcccattcgctcgctgttttttccgcagattcatattctcggtacatcaatgggaagcaatgaggaattcgcggatatgctggaattgataaaccgctgcgagctccgtcccattatcgaccgcatgtaccctctcagtgaagcagctcccgcttttaacagaatgcgggaaggacggcagttcggcaatatcggctttcgtatagatgtctaaaaaaaggaacggacccgtccgttcccttatttgtttttaagcgtttccgcttgaaattcaatatgtttttcttcatcgattaaaatctgcccgcaaatcgactgcagacacacagagcccgtcatgttttttaaggcgtcattttaaacggcagcgatgacttccgccgtcagcagcaccctgatcgattgcgcaaggcttgcaaatcgtatcagtctgcggaaaaaaacaatctctccgctctgtaaaacaaaattccatatttatcctccatttccacattacctttatatgaccaatacaagaagaaggaggttccatttcaatacgaaaaaccggctgatcccagccggttttataaataaacccctttatttacggtaaaacagtgctccccattaaataactgtcgacttcgcgcgctgcttcccggccttcattaatcgcccatacaatcaggctttggccccttctcgcatcccctgcggcgaaaacaccgtcaacattcgttttataatccccatatgccgcctgaattttatgatttgccgaatcgactccgaactgtttcaataatggctgttctgtcccttcaaaaccgatggcgatgaacaccagctgagcaggccagactttttctgtaccgggcagttcatgaaattcatactttccgaattcgtttctgactttttccatttgaatggtgtggatctcttgtaagcggccctgcttatcggccaccatttttgtcgtttgaattgaatattctctcgggtctttgccgaactttgcctgcgcttcttcataggcgtattcaagggtaaagacgtgcggctgttcaggccacatattgtcgttcgtgcgcgtctgaggaagtttaggatgtttcccgaactggtgcacgctgcgcgctttttgacgcagcgcggttgccacgcagtcagctcctgtgtctcctccgccgatcacgatgacatctttccctttagcgtctataaattgtttgtctttgaagttggaatctaaatagcttttcgtcgccagtgttaaatagtccatcgcataatggacgccttttgcttcccggccttcaatcagcagattgcgctgcttttgggcgcctgtgcacaaaatgacggcatcaaattgttctttcagctcatctgccgttatatcaacgccgatttcggtatttgtcacaaaatctataccttcctgcgtcaaaagcttaatacggcgttcgacgacatttttctcaagcttcatgctcggaatgccgtacatcagcaggccgccggctctgtcggcacgctcgtagaccgttacggaatgaccggcttgattcagctgatcagcgcttgccagacctgccgggcctgaaccgacgacagcgacttttttacctgtgcgtttcgcgggaattctcggctgaatccatccattttcaaaacctttgtcaatgatcgtccgctcgatgtttttaattgaaacagccggatctgaaatggccagcgtacaagatccttcacaaggagcgggacagacccgccctgtgaattcaggaaagttattcgttttcagaaggcgctccaaggcttctttccagcgcccccgatagacgaggtcattccactccggtatcagattataaatcgggcatccggaggtaaaaccgttgatatcagcgccgatttggcaaaacggtgtgccgcaatccatacaccgcgccccctgccgctttgacgcttcatctgaaaatggagccgaatactctttccaatcctttaagcgagtgagagggtcccgctcagccggtttttctcgtttttcttccatgaatccagttggtttccccatgttcctctcccctttcttactgtactaccgcttgtttttgatctttggcaggcgtttgctgaacctttgtattggcttcaaaagcatacataattgcgtcttcttctgataaacccgccgctttttgttcttcgatgctgaggagcatttgtttatagtttttcggaatgactttgataaaggtttctgcggctttttcccaattgtccaggagatttgcggcttttttgctgtttgtcagcgccgcatgccgtttgaccatttcttgcacttctttgatctccgcctcatccgtcagcttttcaaatgaaatcatttccatgttgcatttgcgtttaaatgctttggcatcttcactcaggacgtatgcgataccgcctgacattcccgccccgaagtttttgccgacttcgccgaggacgacaacccggccgcctgtcatgtattcgcagccgtggtctccgataccttctacaacgacattgactccgctgttacggactgcaaaacgttcaccggcgcgcccgttaatgtacgcttccccgcttgttgctccgtaaaatgcgacgttcccgataataacgttatcgtgtgtttcataattgaaggcatcaggcgctttcacgatgatttttccgcctgaaagccctttgcctacgtagtcatttgaatccccgttcaaatgaagcgtcatccctttagggacaaatgcaccgaaactctgtccggctgatccggtaaaatgaagtctgatcgtatcatccggcaggccttccgctccgtagcgtttagaaatttcacttcccgtcacggttccggctacgcggtttgtattattgatcttgatttcagcttccgcttcctgaccggcttcaattgcagcctgcaccgccggaagaataaccgtcatatcaagcgactcgtcgattttatggttttgcgccgtacggaaagtgcgtatgccttcaggctggtacagcagtgtggataaatcaagctggcccgctttccaatgcgctttcgcacgttcactgacatgaagaacgtctgtccgtccgatcatttcatcaagcgtcttaaagcctaactgcgccatatattcacgcacttcttctgcgacaaacagcatgtaatttacgatatggtcaggattgcccatgaattttttgcggagctccggattttgcgtcgcgacacctacaggacatgtatctaaatggcaggcgcgcatcatgatgcagccaagaacgacaagcggcgctgtagcaaagccgaattcctccgcaccgagcaaggcggccatcacgacatctcggcctgtcatcagcttaccgtccgtttccaataccacgcgatcccgtaaaccgttcagcatcagcgtttggtgagcttctgcaagaccaagctcccacggaagaccggtatgtttaatactcgttttcggcgatgcgcccgttccgccatcgtagccgctgatgacgatgacatccgcagtgccttttgccacaccggccgcaatcgtgccgacaccggcttttgacacgagcttgacgctgattcgcgcgcttcgatttgcatttttcaaatcatggatcagctgcgccaaatcttcaattgaataaatatcatggtgaggaggcggtgagatcagccctacacctggtgtagaaccgcggacatccgcgacccaaggatatactttgttccccggaagctgaccgccttctcccggcttcgctccttgcgccattttgatctgcaattcatccgcattgacgagataatggctctttacgccgaaacggccggaggcgatctgtttaatcgcacttcttctgtcgtcgccattttcatccggaacgaaacgtttcgggtcctcgccgccttctccgctgttgctttttccgccaagcctgttcatcgctatcgctaaagcctcatgggcttccttgcttaatgaaccgaatgacatcgctcctgttttaaaacgtttcacgatggacgcagctgattcaacttcctctaattttaaaggcttgcggtcttctttgaaggcgaacagattgcgtaaaaatccgattcgttcttcatccgctgcatgagaatactgcttaaacaagctgtaatcattttttcggcaggcccattgcagcgtatggatggttttcgggttgaaagcgtggtgctctcccccgttccgccattggaattcacttccaggatcaagagtttggctgtaatcatccttgtacgccgcttgatggcgctgtttcgcttcttgcgcaatcgtctcgatatcgattccgccaagctgagatgcagtaccggtaaagtatttggcgataacgtcttcaccgatgccgaccgcttcaaaaatttgggcgcccctgtaactttgcacagttgaaatccccatttttgacatcactttcacgacgccttctgttacgctctttccgtatttgctgacagcttcttcatacggaatatcaagccggccttcatcgatttcctgcttatacgtagcataagtcaaatacggattgacagcatcggcaccatacccgatgagagccgcaaagtgatgaacttcacgcgcttccccggattcaacgataatgcttgcttttgttcgcaggccttgacggatcaaatgctgatgcagcgcactgacggccaaaagcggcggaatcggcgtcaattccttactcattgccctgtcagataaaattaacagagatacgccttccttgatcgctttttccgcttgctgaaacaaatccttcaggcctttttccaggtcatcggaaaacagcgtgcggatgttctggctcttaatatcagggtgcacaagtgttttcagcgcataaaactgttcgtttgataatacaggagtatacaattttatgcggcgtgcatttctttcactcggatgcagcagatcaccttcagccccaagccatgtcaccgtagaggtcacaagctgctcgcggatcgcgtcaatcggcgggtttgtgacttgcgcaaacagctgtttaaagtaatgaaacagtgattgggcgcgatcggataaaacggcgagcggcgaatcatttcccatagagccgagcgggtccttgccttctttaataacaggaattaaatatttctggatatcttcatacgtatagccaaacgctttttgacggacgagaagatcatcgaattgttcctcttcccggatttccgggtcaggattcacttgaaccaattcttcttcaagccatttttgatacgggaattcattggcgatttctgtttttacttcttcatctgaaataatccggccttcctctaagtcaatgagcagcatttttccgggctccagacgttttttatgaagaatgttcttctgctccacttcaataacgccgacctcagatgagaaaataatatggtcatcttttgtcacatagtaacgtgccggacgcaggccgttacggtcaaggatggcgccgatttgttttccgtccgtaaacgaaatggcggtcggcccgtcccacggctccattaaagagctgtgatattcataaaaagcccgtttcgctttagacatgtgagtgttttccgtccatggttccggaatcagcatcattgccgtatgtgccggtttccgccccgccatcacgaaaaattcaaacgcattatcaagaatggatgagtcactgccctcagcatttaaaatcggcagcactttgtgaagatcgtctccgaagctttctgaaacgaactgctgctccctcgctctcatccaattgatgttgccccggagcgtattgatttctccgttatgaatcagatagcggttcggatgggcacgttcccaagtaggaaaggtatttgtgctgaatcttgaatgcacgagtgaaaatgcagatacgaaggtttcatcctgcaaatccaaataaaaagcgtcaacctgctcaggcgttaacaaccctttataaacaatagtctggcttgacaggcttgcgaagtaaaaatcaagctgttcttgaacgccccaattttcagcctgcttccggataacatacaatttgcgttcaaaagcaaggctgtctttcaaatcgtttgcggctccgataaatacttgacgcacatacgggcaagtgctttgtgccactgttccgatttttccgacatttacagggacggttctccagccgagaacgatctgtccttcctgctcaatgaatgcattcacctgtttttcgatcttttttctttcctcttcattttgcgagaaaaagaccattcctaccccgtaacggcctttttccggcagcttcatttctccgcactctttcttaaaaaaagcatcagggatctgaaccatcaggccggcgccgtcacccgtattcggatcactgccctgtcctcctctgtgatccagctggcaaagcatcttcagtccttttttgacaatgtcatgtgaaggtttcccttttaaatgggcatacaagccgattccgcatgcatcgtgctcaaattccggacggtagagaccttgtgctttcggcatttgattgtaagtcataattcctctcccccgatcagtttccgttaattatcggtcataaaatctgacaactttaaattaattgtaagttttcaaaacaatataaacaatatataatttagatcaaatacatctcaaaatgagatagatgggtgtgaacgcaatggaattacgccagcttcggtattttatggaggtagcagaacgggaacatgtgtcagaagcggctgatcatctgcatgtcgcacaatccgccatcagccggcagattgcaaatcttgaagaagagctgaaagtcactttatttgaacgggaaggcagaaatattaaattaacgccgatcggcaaacaatttttagaacatgttaaaacggcgatgaaagcaattgattatgcgaaggaacaaattgatgaatatcttgatccgaatcgcggaaccgtcaaaataggatttccgacgagccttgcaagccagcttttgccgactgtgatttcggcatttaaagaggaatacccgaacgttgagtttttgctccgccagggttcttataagtttttaatcgaagcggtaagaaacagggatatagatgctgcgctgctcggccccgttccgacggaattccccgacataacaggcaatatcttattcacggaaaagatttacgcgcttgttccgctgcatcatccgcttgccaaacagaaaaatattcatttaattgatctgcgcggggaccaattcgttttatttcctgaagggtttattctccgaaacatggcgattgacgcttgcagacaggccggctttgcgccgcttgtatcgacggaaggcgaggatttagatgccattaaaggattagtctccgcggggatgggagttactttattgcctgaaagcacctttgcagaaaccacaccccggttcacggtcaaaattccgattgaatttcctcaagtgaagcggaccgtaggcattattaaaccaaaaggaagagaactggctccgtctgcaaatgatttctatcattttgtcattcaatttttctccaaacttgaacaatatcaataaaaaacaaacccgagcttcaaaacgaagcctcgggctttttcatatttttatagatctttctcagccgatcggaatggatagttcaacgtggcagacaaacgcttccggatcaatgactgattgatcggtctgtttgtgaggcgtttctttaaatgtcttcagctgggctgaggaatagttgacgatgccgagtccgagctcttctccctgctgatcaagcagcctgacaaccgctccgctgctgaatctgcccttaatctgttcgatatcctgcggtgacagcgccatatttccgtttgcgacatcgcggctgcttttcttttccatcacaatttcgccttcggggccggaattaaatgcaagccattgttctttgtggtttaacggcagggttccttccgcttcaaaataagttccttcagccgcctcatctaccgcttgaagcagaatgtccggaatgttagcctgcccgagaaagcctttaataccggaggccatcacaatcttaaaagcatccagtttcgaacgcattccgccggttcccatttcactcccggcatctcccgcgcttgcttctatttccggagtgatgtcacttacatgtctgattcttttcgctttcgggttgctgcgcggattatcatcatataaaccgtcaatgtctgataaaattacaagcatgtcggcatcaattaaacctgccaccttcgctgcaagtgtatcgttatctccgaatttcagccggttgactgtgaccgtgtcattttcattaataatcggaataatgccccgttccaaaaggacgttcatcgtattgcgcacattatggtagcggtattcatcggaaaaatcgcttcttgtaattaatatttgtgatgcgacataaccgtgcgctaaaaacagctttgagtaagcctccattaataatccctgcccgatggaagcagaagcctgtttttcagggaggccttccggtttctgaataaatccgagcttccgataacctgccgccactgcgccggaagatattaaaatcacttcatagccgctgtccttcagctgtgcgatttgatccaccaatgcttccagctttcttctgctgatttccccgtgcaggctcgtcagtgagctgcttccgattttcaccgcgactcttttgatcttcgtccgagacgtcactgtatcactcctgttttttaacgattatagtgctgccgttttttcaattgttttgctgatctcaatagaacgttcggtcgcgtgtttaatggctttggcaatggcttctccgccgccttctgacctgagcgcatcgaggccggcttccgtcgtgccgtttggagaggtgatgttttcccgaagcacatccggtttttcacccgtttccatcagcatttttgcagcgcccaataacgtttgcgccccgattttgcgggacagccgtttgtctaagccggcttcttcacctgctttttcaataaactccattaaataataaaagtacgccggtccgctgcctgcgatgccggtgaaaatgtccatctgatcttccttgatcacgtacacttccccgaggcattccaaaagagataccgcggtttttgctgaaccgtaagagacatggtctccgaaagccgcagctgttgccgattcgccgatcatgctggatgtgttcggcatcactcttacaactggctgacggtcatgtaatgattgttgtataaatgaggttgttatgcctgccagaacagacaggatgatttgatgaggttgaatacgccgtttcagcgtagcaagagcgatttcagcatccttcggtttcatggctaaaataaagacatcaatgtcttcggttttcatgctgtcaaaagcaatgccttgaattccgtattgatgttccaattcagcgagtcgctctgtattgcggcggtttgtcacgcagatgttttggttgggaattttttttgcgcggaccatgcctgatatcattccttcagccattgatcctgctccgataaaagcaactttcttttgatctaagatcggtaacatctcccttgttcgtattttgttcgtatttttcacacgttttttatgttaccacttcaggagtcgatgtcaagtttggaggttttattgatatgtattgttccgagcctgttattatgtataatgaatcacagaacaaaccttttgagcccgggaggccgggagcgttccggccggatttaaaaattatctgaaatggctttttctatcagctttttgcagcggtcaagctctgtcttcagctgttttttgtaaagctttgcagcttcatagtctttaaattgatagagaacgacttcctggagtttggctccctcttttttcacttttacttgctttaaaatcccgtcatccaaaagttcgtgaagtgaacggtacacctcggtatgattcggcttaaaaccgatgggtttaaattccgaacgcagcacctcgagaagcttcagtccgtaaagccgttcctgctctgtcattgtaatcatgtaaagctttaaaaaggctctttgttttactaaaaaaccggttgaacttcttttttcttctttcaatatgtgcccacccttccttctaacaaattattccatgtactaaatattctctttatatcccgttttcccttttattgttcggacagtttggtttatattgatttgttttttggatgcggggaaaaataatcttattgaacatttggtacatagtttatttagtttaattatagctgatatcggtttctttttcactcttttttctgcaaaaacggatctttatgcctatttaatcgggttgcgaaaacaaaaaagacccgtcacaaagacaggtccccttttgattaaggattagttgaccacaaaccggcagttttgatgaaaatgcgcgggtgtaatttcaattgagcaaccatatattctgcaagatcctcaggctgcatgactttttccggattgccgtctgtcagatttaattcaatagacatgtcgcttgcaaccgtgctcggagtcattgcgctgacacggatattgtgttttctgacttcctgcatgagagattcggtcagaccgagaacggcaaatttagaagcgctgtacgcacttgtcgccgcggcgcctctttggcccgccgtagaagaaatattaatgatatctcctgattttctctcaatcatttcaggaagaacggcgcgtgtcacgtggtatacacccattacattaacttgaatgatgtcttcccactcttgaggcgtaagatccaaaaatccgccgaatttgctgattccggcattgttaatcaggatgtcaacctcaccgagttcttctttaatagaagagacggcttgttcaacctctttttggttttttacatcggcagcagcgaatgatgcctttacaccaagggctttcacttcttccgcaaccttttcgacatttgcttctgtacggccgattaaaccgatattgactccttctttggctaaagcgatagcggcggcgcggccgattcctctgcccgcacccgtgataagagccgttttgttttgtaagctttccatgtctttcaccctttctgaatgtccttatgtacgatttcacattataagcagaaaaaaaacaattagcaaataaaatgattcagcacgatccgtaaagggtatcaactgaaaaaaaggagtgaaaagcagatgatcatcattttgtatatcagtgctgccgttgcggctgccgctttaatttatgcagccgtatccgccgtgcattttaaaagaaacacagcgcctgatataaagaagattaacgccgtgacagcgtccatgcagacgtccgttgaagaaatcaaaacagaaacccgtttgttatcacaaaagcagaaagaactgcaggaagactttcttactaaaaaaacagccgtgcaaacgacggcagccgaagttaaaggaacgcctcacgtcctgaaaatgctctggaacgccggtaaaagcggtttatgagcctgcatgtcatccgacgtttttgatgacactaagagaaactggcggattcaaggaggcataacatgatttgcgatcgtgagcggcttgcgcattttttgcagcagcttaaagcattatcatcttcgggaggatttacaaaatcggatttgctgacttcggagttccatttagccaaggacggagatctggatatgtattattcgcctcataatgagtatatcaacccacatgctgcggttgtcatctccggaattacacccggtttttttcagatgcagcgggcgtacaaagcagcggcacagcttttaaaaaacggcgaatctcttgaggtgatagcatatgagacaaaaaaagcggccggactttccggttccatgaggcagcacatcatcgaaatgcttaatgaatgcggtctgccggccgcgcttcacgttgaggattcatcccggttttttgattcaaaaagggagctgcttcatacgacatccgttatcaaacaccctgttttttataaacagaaaaactatacgggacaccggccggccatcagcagatcagctcttctcagccgttacgcgctgacatgttttccggatgaaatagaaatgatgaaaaaagacattctgcttatccctctcggaaaagcagcagaatcagcctgccgcacgctgaagaagaaccgcagaatgggccatgcggtcattctggaaggcttcccgcatccgtccggagcaaacggacatcgtttcaaacaatttcacgaaaacaaacaatcgttacgtgaacaaattcagcggtttgccgggtttcttcatcagccgtaaaaaaacgccccgaattttcggggcgctgctgttaagaagcgtattcaggcaatgctttattgtgttttgccgttttctcttcaggtattttgatttgatttgtcaagatcgcacttacgaaatagagcgctgcgaaaatccatacaacgccttgtgcgccgacaagcccgatgaacgcccaggcaagcgcggggccgacaaatgccgacaggcccgcagccagatttaacacagacatagcagcacctttattgctgccggccgccgtcggcacgatagccccgatcggaacgaacccggcgaggagccctccccatataaaaccgacaatgctgacgaacagcaaattcccatgtgatacaacaggagcataatataataaaagagtaaaaatgccgcagcccactcctccgaaccacatgacagtctttttccagccgaaggcatcgccgactgcgccgaagattaagttaaagacgatatttccgagaaaaatcgttccccaaatttgcagccatacatttgtagaaatgccgtgctgcgccatatgcatcgggaggaataccggaaatccgtatgttccgatgctgttaatgattcgaatgatcccccagagagcacgcgcggattttcagcaaggatggtgattcccttcattaattcctgcgccttttcccgcttatctgcctttttcttttcaaagcggtccctatttaaaatcaaagcaaaaaacgcgccgagacatacccagaaaattgaactccacagcgtattcaaatagccgaaggatttgatggcccagcttgaataccaagcaccgaatacaaacatcccgcagcaatatgcaatccagaaccagccgaccgccgtactgagcctgtttttcggcgaccggtaaatcacccatgtcaaaaatgaataggcaaacagcgggtaacccagccctttaataaaatacgtgacatacatcaccggcaaattaagattctcaaatccgtatgcgataaacgcggctgttccgatgacgtaaaacaacagccccataaacatcgtccgctttgcgccgaaggcttcgaggcagactcctgaaaaccacgacgccacagcaagagaaataccgtaaaccgtaaacaaggatgctgattgctgtaccgtcaagccgttttcgactaaaaacgggctgagccagccttgttcaaggccgtcccccatcataaacagcacgacccctaaaaatccccaggcgagctgtttcggaattcctattttattaagcatttttgttcctcctcagcaatctttcatgttgtcatctcatccccaagtcaggctttcaccgccggctgaaaatgagtaaataatttttgggtatgtttccattcttcatataggaagagatccgtctgatccgcttccggctcaattacctttgtgcaggtcgaaagctctgctttcacaccgagagcttcgttgcaaatcatcaccgctcccattgcggatgcctggctgaacccctctctcttatagattttcttttgaagaaggttagcaagaaactgcgtcaaagcatcactttggaaaccgccgccgcacaccttcacataatcttgtgaaaaggaagccgcctctgttaacgcctcatagttccatttgattgaaaaagcgatttccagcagtgcagctttgacaaaatgggctctgcttaagttttgggacagcggagcgtcaaaaataaatccgccttttgccagtgcgtttttctcaggagataaataggagcctaacgcagatatacaggcatgatcatgtttcggcagacttgcgatttcccgttccatgacgctgtaggattcattcggataaaaaatggattttaatttttgataattgagtcctgttacacccggattcgtttcaagaagccattcaccttcttctgtatggcaattcagccatgcattctctaaactttcggttccggtctccgctgttatctttgtaatcggcgtcgtcgtgccggatacaatgacgatatctcccggctttgcatctgcacttttgatggcaagctgtgtgtctcccccgcctgcaatcacaggcactctttcagaaagaccgagcaccgccgctttcttaaacgttaacattccgacaaccgtcccagatcggacgagtgaaggaagaatggcagaaggcacaccgaagatgttgcataatttctctgaccacgcctttttccttacgtcaaacagcagtgtttcagcagcctgtgacggttcatagcttaaaattccgctcagctcaaatgtcacccagtcactgatgcttgtgatgcacttcacttctttccataaagacggctgtctggcttttaatccgacaagtttcatggcggaaaataaagcgctcggaagacgtccggtttgctgatgcacttcttctgcctcaattccgccttcccattcacgccctctgttatcaatgttgggcagaccgagaaatgcctttttatctttattgatcaaaacgattccctgcctctggcttgttgaggtgattccgattaatgtaatatgagggctcttggcaatagcctttcttgccatagcgctgatttgcgtccataacccttccggtgagaaatatcgtccgtccggataaagcggatccgtcacatattcaatgtcttccctttcaagcgcggtcacttcgccgccggcagtcacgaccgcgactcgcgcattcccagtcccgatgtcaaatacaaggtagcctttttgttcagccattacagcctcctccttccgtttcaagttctcttttgttataaagttcacgtattgaataggtttgatcttgtttccatttgaaaagcgcttcatttaaaatcttcacatgatgatcttccacttcaaatgttgcgcccgctaaatggggagtcgcgaacacattcggcaaagagatcaaatcataatcagaagattcaggcggttcgtgataaaacacgtcaaggatcgctcccttaatccgccgttctttcagcacccgcagcagctcttccctgtctgtaaccgccgctcttgacgtattgacaaaaacagcttcctgtttcatcaattgaaagtgccgggcgccgataaggccgatggtttcttctgtgcgcggcaagtgaacggaaacaatatcactttcagaaaatacccgttcaatcgtcgttttttcatactcccggttttcatgacggacaaatggatcatagtaaagcaccttgcagtcaaaagcggccaatagcctggcgattctctgtccgacagctccgaaaccgataaggccgactgttttccccgtcagctcatttcctctgaatttgacgtaagcctgcaaataatcaccattccactttccgtccttcagccactgatgggaagaatacgtatgacgcaaaaatgaaatcacattcccgataaacatttcagcaacggcctgggcattgcgggccggtgtaaagaaaacggggatttttcttttagtcgccgccgcaatatccacattagacggcattcctctgcagacaccgataaaagcggaatccggcaatatgtcaataacacgctgagacacctcatcaagttcggttataagccccgacgcgtttgtctcttgaatcatccggatcaattcatcttcccgataggcccggccgtgcttcttccacggccggtgcacagtccggccgaacagctcagccagctccttcagcccctcgtcgtgatatggcgcggtaattaaaaccgtcatggtgcaaaacatccttttcacataaattttttcataaaaaaatctctttcctcaaagaaggaaagagattcatataccgtctttatacgcttgaagcgcacaaatatgtatagaccattctttcctatctttcaagcatacgcttgctggaattggcacaataaatgttgccgaggattcatagggccagtccctccacctctctggatagaaaataaaatgatgaaattgtcaggctgtttaaaagaataaactcatcatagaaaagtctttccgtaatgtcaacacttttttctgaattgacgttcgattttgaaatgttataatgcttacaatataaacaaagaggagaaatgggctatgaattctgctgcaacacagccgaacggggtctttaagtcggtgtgctcactagactgtcccgatcaatgcggcttgcttgtgacaaaaaaagacggaaaaatcgttaacattcagggagaccccgatcacccggtcacatcagggaatatttgcaacaaagtcagacacatggctgagcgtatttatgatgagaagcgcgtaaccgttccgttaaaaaggatcggtaaaaaaggtgaagccgcgtttgcgcctatttcctgggaggaagcaatcaatacgatcagttcgcgctggaaagagcttattgccgaagaaggagcggaaagcattcttccgtacagcttttacggcaatatgggaaaactggcggcagagggaatggaccgccgttttttccatcgtctcggagcgagtcatctcgaacggacgatctgcagcaaagccggttctgaaggctataactatacaatgggagaaggagcgggtactgatccggaggagaccatacatgctaagctctttattttttggggaatcaatgccgtcagcacgaatatgcaccaagtcatgattgctcaaaaagcccggaaaaaaggggctaagattgtcgttattgatgtacataagaaccaaaccggccggcttgctgattggtttattcccattcgtcccggcacagatgccgcactcgccctcggtatcatgcatgtcttattcgctgagaaccttcacgatgaagcatttctcacagaatacaccgaaggcagtgacgaattaaaagcgcatgtcaaacactatgatccggaaacggtttctgctattacaggcgttaaagccgacgatatcagacgccttgcgagaatgtacggggaaacctccccttcccttatcaggatcggaaacggcattcagcaccatgacaatggcggaatgatcgtccgcaccgtcgcctgccttccggctgttacaggacagtggctcaacaccggaggaggcgcaatcaagcacaacagcgcggtattaaactataacagacaagcgctccagcggcctgatctgctttacggccggaagccgcgatcatttaatatgaacaggctcggaagcgttcttttagaaacaaaaccgcccgtgcgctccctgtttatttacggtacgaatcccgcagtggttgcgccggaagcgaataaagtcagaaaaggcctgctgcgggaggatttatttacagtcgttcacgatctgtttttaacggaaaccgccaaatatgcggatatcgtgctccctgcttcatccgcttttgaaaacacggatttttacacgtcttactggcatcattttattcagctgcaaaaaccggtgatcgaaccctacggagacagcaaatcgaatacggaagtgttccgtctgcttgccggagcaatgggatttaccgagcaggagcttcaggattctgatgaagaattaatcagacaggcgctggactttcccgacaatccgtatatcgaggatattgattacgaagcgctctcaagccattccttcatgaaagccaaacggaaaaaaccgctttttccgggaaagctcaagacaccgagcggaagaattgaattatattcggaaaagatgaaacaggacggttatccggcgctgccgacacacatccctcttgagagcgatgacgattttccgcttttatttgtcccgggaccgaatcataattttttaaattcgacattttcaaataacgaaaaacacgtaaaactggaaaaagcgccaaaactttttattcatacagaagaggctgtacaccggaacatagaagacggagaaaccgttagagtttggaatcaccgcggagagtgcgaattgactgtttcggtcggcgaacaggtgcttcccggcgttgcggtgagccaaggtctttgggccgatatggatgataaaaaacagctcgtcaattcactcacgcccgatcggctggcggatatgggcggaggtgctgttttcttctccggaaaggtgcaggtggaaaagctcagcaatcaaaaccgtccgcaataaacgcccggcggttttgctgaaggctgaatcctccggccggcttcaccgtataaaaaatgataacgtttattggaggtttggatatattaccggcattggaatcgctttagccggatatttcatcggagacggattgaaaactttaactcacctgatcctcatgaatatctgacattccgcatatcacgagaaacggaaagcggtatgtgcagaaaccggcattaagagaatggctgacttccatgctggaaaaagaataacagctgctatgaaaagcgggaagagtttttctcttcccgttcattaagatttgccccactgcctctcttcaaccccaaacatacgacagatatcgttcttacgtaacgaaacatccccttcttttgatttcaaataaaaccctttcttatataaccgtatgacttcctcatatgtaagctcatgacgaaggaacgccattaaacgcccatctttttcatcttgtttattgaaccattcataccgttctgaccagttcactttctgaatgtcaaacaccttcccactttggattaatgcccttttcgcatttattatacttatttccccttttgtaaacactccgactgtctgtggcatttttgaaaacagccgtacccgccctattagtcaccatgttgacttatttcccttcgtgatgtatattgtaattgtcaacatggtgacaatttagatgggagataacttatggatattaaattactaatgaaggaactgcattttatgcaacaaagttacgcatcattattttcggttgtcaataaggtgcagactcggggggacgaatacttagaaatgttgacttcccgacagcacatgactcttattgctattgcccatttaccgacggaagataccacacttatgaatatcgctaaaaagctgggcacaacaaaacaaaccgctaacaaattaatttcaagtctctcgaaaaaaggatatgttcacactgtgccaagcaaactggataaacgtgcaatcaatattgagattacccctgaaggaaaaaaagcgttaatttcctgttcagaaagatccacctattttttagcggatatgtttcatgagttcacaactgaagaagttgaaacattctggaggctattgcaaaaactttatcgttttgatggtgaagaacaggacggttttgaagaaaaagcacatttgaaagttgaagaccaggcacaatccatctcagatgactatgaagaaaaaatcatggctgaattttcaaaacggcgatatgggagtgcaaacgatgaataatatgctttatcgaaaagtaaaagaaactgaggataagatgaaggaaaaatgctatgagctgaaagataaaattgatcaatttatttctcatgctaaatataaacttcattgcaatcgtaaactggaccgagccggcaattatatatcaattgccattggactctttatcctaactgcctcatggctgaccgcaacacaatggctgctttggataggcgcggcgagtattttgagtaatgcctgtttgctcattataaagcctgttaaaaattgaaaatctgaaaaaagctctctaaaagagagctttcttttattaatcgtcttagtcttcatcttcttcccgattttctttcatttcatgaagtctttcataaaagaactttataaaatgggcagaattaagttctttatagccaccgaattcactccaaataacaactggacattctcctttccgttactttaagtacatttattcacaaagtaatcttttttacaggtcatttagtggcagccccaggaaaatgcgaatttacaacgttaatcaaattcaaacataaaaaagtcgaattccctgtcctttaaggaaaacgacttttttatacggcttcttcaagtaaatccccattaaccttttttggggaagatttgtaacctctgcgcagtgaaattatacctgtgctagcccgccatctacgaacaattcaatacccgtcaagtaactgctttcgtctgaagcaaggaaagatacagcgttagctacttcttcaggtgtcccaacttttccagctggaacagtatttctggcattttccatcgctccttcaagtgcatcaccaaaaagctcatcgtatgcaggtgtaagaatcactcctggacttaccacatttacacggatttcagtaccttttaggtcaagaatccagttgcgaaccagtgctcttaatgctgctttagatgctccatatacactaaatgctgggttgccaattgatccagcggtggagcccgttacaataatagaacctactttgtccgggaatagtgataacgctttttgaacagtaaaaatggttcctttcacgttaatgccgaacgttctatcaacctgctcttcagtaatttcacctaatggaagaaagctgccgatgcctgcattagcaaaaaggatgtccaacttacctttttcctgctttatcatgtcatatagtttgtctaagtcttcaagcttagaaatatcaccttgaacaccggttacgttcttgccaatttggttaacagctttatcaagttcgttttgtctacgtcccgtgatataaacatatgcaccttcgtttacaaatttttgtgctgcagcaagaccaatcccacttgttccacccgttacaagcgctactttaccttcaaattcacccatacttaacactcctttagaattaatattattttatgtctagtacctttaagtacttgaagaacaacttacaagtaatagtatccttcagtaagcacattatcggaagtacccacttttttgtgatatagtaactaaaaagtaataaatgtggaatggagagctttagacatgaaaaaatttagctgtgggtttgaagtgacaaaggaagtgattggcggaaaatggaaaggccttgtattatactttttaatgaatggaccgaagagaacgagtgaattaaagcgcattatcccaaatataactcagaaaatgctgattcaaacacttagagagcttgaagccagtggacttgtgagcagaaagatgtataaccaagtaccgccgaaggttgaatattcatccactgaacttggagaatctcttaaacctatcttgcaggagctctgtcaatggggagaccattatgcggagcaaaagtatgcagaaggtgaatatgaaattgtacagccagaacaactaagttaggattgatgcagctgctgaagtaaatgctaaacaacttcaataccatcacctaacagatgaagaacagtcagaaataaatgagatattcaattttgaaagtgaagttataataagaagtgtcatggactatattcaggagaactttgatgaaattcaaaaaagagctgtttcaaatgttaaagagaaggttcagaaacttagccaaaagataaatgaagacatcagtaataacatttaatgcctatatggtctcttcgcatgcatcttttacacaaaaagacccggattttaattccaggtcacacttcggtcacaacttgctcaaattccctcttgcatttgtcgaactgctttattcaagatcataaaatttcaaacgaaccttacacgaaggaatcggggatcggcaaaacaaagccagatataacatatattaaaaaatctcttgcatttccacaccggccatgctatattcatatagcgatgagctgaattgtgtaagccgatgcacatgcccttgcggcacacacgaatgtggcgtgtggtgtatcgcctcaatacgcaaaagacgtttgcttctgcaaacgtctttttttattatccgattttcgttccgttcggtactgactgctctggcgtaagcaggacaacatctcctttttccgggatgccgccaagaacgagaacttctgacttaaatccggcgatccgccgcggcggaaagttgacaatagcggtaacctgcctgcctgtcagatcacccggttcgtaccgttttgtaatctgggcgcttgattgtttcatgccgatctcttcgccgaaatctattgtcatcttaatggccggcacctttgcttccgggaatacttccgcttttacgaccgttcctattctgagatcgagcttgataaaatcttcgatgactgccatatcaaaaactccttttttacaatcatgataccaaaaaaagacgcagtttatttaactgattttcaggattatttatcagattgaaaggtgtttcggaagacgcgcggcgttattcccttatgtctgacaaaccatctggtaaaggaagacaaattttgaaagccgacctcctgactgatgtctgtcagccggcattttgtttcaataagcatttgttccgctttcttcatacggagctcagcaatataagcttgcgggcttttccctgtctgctttttaaaccagtcggaataatacgccgggtggtaatgttccattgcggcaagctctttaattgaaaaagtctttgagagatttcggcggatatacgcaattgaatcattcgtacggttttcttgtatcttttcagcaatatattctgcaagcagactcaatgaatgagccgactgctgcttagtctcttctgtcagcagaaaccgaatcgatgtccaaaaagaatcaagcttattcagaacgccgggatcaaatgaacctttgaaaaaatatgccggtatgtcgagaacgagacattcgtttcgctccaaagaacggaaccgatgttcatgcccgggcggaatatacagcatttgatcaggttttaatctgatttcacgtctttctgtctccaagtccagctgtccttcgagcggaaagagcatttggcagtatgtgtgtgcatgagaatcaaaaatatgtgaataggtgcgccgctcacaaatgatatgttgtaatgaatccatttgtccctccttttactgatgcgtttttttatttagtttacataataatattattgttacctaccctgtaaacctcttaggaaagcaacaactgcaaacttccggctttccttaattgattcggttaattcaaatgcactctgttttctcaacacggcaaagccgtgaagaaggctcctcagtcctctcgcagcatgaatcgcagtgtcagactgtgcataaccgttagctgtcagctgcctgacaacaagctctacaagcaggcttgacagattctcaatccggccgtcttttatcttttgaaatgttgcgtcatataatccgggattggcttcggcgaaattgatataggcatcggcaagagcgagcaaagccgtttcacccgtcagtccttctgcagaggccgccattttttcaaataacatagttaaaccggagacagccagctctgttttaattccttgaaggccattgacaaaattgtaaagggaaggcggttttacgtttaaggactttgcaacggccgcaagcgtcacttcgttcagcccttttttgtcagcgatgcctgctgcggctctcaatatcatgtcaaggctcattccgactctcggtgacattatgatcggcctcccggcaggcttcgttcagcttcctcagcagcctcagccatcatttcaacgggattgcagagaacatttccatgtccggcggccagactgcttggttgatgagcgataagcgttcttgctgtttttacagcttcttctttattccacgtagcaaaagccggaaacggaaatttccatttcagcttccctgaaacagcaaggccgccccgtacttgaaaggcatctccgacgatcagcatatcatttctcatatctttaaaagcgaggcttcccggcgtatgaccgggagcgggaatgacaagtaaagatccgatccgctcgccgcctttcagcaggcgatcaggttcggtctgaacatttttcggcactcccccctttatcggcgtttgtgcttcatgctcaaataatgaagtgtcacctttcagcaagaaagaatcccgctcagaaatacagacggaggcatccggaaattccgcagctaatgagtcaagcgaaccgatgtgatccccgtgcgcgtgggtgagtaatatgtcattcagcggcttcccaagctgccgcaatgcttgtttgattcctttatgactgttaggcagtccggcgtcaatcagggttactcctacttcttcttcgaccaaataacaattcaccgggaaaagcgctggaaaaaaagtcagctgccaaacccttccgtattgtaagattctcatcaacatccccctaaaactaatatcgttagttttattataactaataccgttagtttatcaagagttttctgtttaaatcctgaaaaaggcgcgggcgcttctcttatgcaaaaaaaagaaacgcgcatactgtgataaaagatgctttcagcctgcgaataaatcagactactaaaaccagccggataagcatacactactcaacggagggggagtttcacaccatgcatatcacacttcaaagcatctgccctgtcttaatgattgccttttttctgtataaaaaggtgaaacggtccgtcggctttcagcctttgaaaccccgctggctttatacaagaatgattttgttttcattgctggccgcagctctggcgtttttcagcatcacacacccggctttatacggccatcttatattcggcactttttgcggctggcttctggtcctgtttgccaaacggaatatttcttttgaagaacgccgcggaaaaatgtattttcgcactcatctgtggattgaacttattctattaacgtttttcctatcgagatttgtttatcgcgttattgaaatttaccgggtcacagcggactttacccatccggaggcatacagccaaacggtcggggccgatccgctgaccatcagtatcttttatttcatcgcagtttattacagcggcttctctttttatgttttaaaaacgagcagagaccaaaccaataacagtcagtacggctgacatccctgtctaaaaagcagggatgttttttaatcgtgccgcgtatggtgaatcatttgctgaagcacatctaacacatgttcatcctcaggagaataatagatggatgttccttctctgcgtgatttgacgaggcgtagatttttaagaaaacgcagctgatgagaaacggtagactgcagcaaattcagcttttctgcgatatcatttaccgcgtgttcaccctgtgacagcaaatggagaattctgattctggtcggatcagacagcgccttaaaagtctgggcaaccaaaaataaagtttcctcatctaaatcgacagcggggtcattcgtctttccggattcgtgaaattcagtcatatacctcacccttcttttctcaagtagcccaattataccaaatgtcaattgatgcagatacatcctgcgcctgacaaaagaaccgttattttaaatttatgtttcaaatacgggtttccgcttggtttcgcgcatccatctgtgtcataatgaaaaagtcataatgctcctgaaattgagggtgaaacacagtggagaaaaagaaaaaaggctgtttcgctgccgcgggtcttatgatgatatgtgtttttgtcatggtttccttcttcctcattctgttattttcaaataatgaatggctcaaaagtcttccgtttgatgtcaaaccgatcgtgcttgaacggctgacagattacaaaccgcttgttgaagacgagctggatgaaaaaggactcaccaaatatacatcgcttgtactcggcatgatatatcaggagtcaaaaggaagaggaaatgatcccatgcagtcttcagaatctctgggtttaaagcgaaatgagattaaaaaccctcaaaccagtatcaaacagggaatcaaacaattcactctcatgtaccaaacaggcaagaaaaaaggcgtagacttggatacgattatacaaagctacaacatgggagccggctatattgattttgtggctgaacatggaggatcgcatactgaggaactggcaaaacaatactccgagcagcaggtcaaaaagaatccgaaactttacacttgcggagggaacaaagacaatttccgttatccctactgctatggtgattacacgtacgcagaaaaagtaaaagcaaaaacaaaaaccgttgaacaatccttaaatgtaacaacacttgaaacgcttgaagagtaaaaggcgccctgatgaggcgcctttttccatcaatagaaaaaagccgcgcagagcacggctttttttaataatacggtgagatcattaagtatacaatgacacccgtcagactgacatacagccagagcggcatcgtccatctcgcgatttttttgtggcgctccacctgcatgctgaatcctctgatcagcgtaaacagcgcaagcggcacgataacggcggaaagacagatgtgcgtaatcaaaataaagaaataaatcccccgaatgatgccgtggccgccgaataaagtattctcagctatcgagtggtacacgacatagcagatcaaaaacagcagagtcgtcgtaaacgccgccaaaataaagcgtttatgcgcttgaatatttttttgcttaatcataaagagcgctgccagcaaaaagataaaagtaaagctgttaaaaatagcatttaacatcggcagaatatgaatattggcaatgctgacctgtcccgatttcggcataaaaaacagcaccgcaattaacccgttgatcaaaacggtcaatgtcagcacgataccggtataacttttaggtttgttttctgtctgattcatcttatgacctctctcaattttactgactatccaaatggtatgagaattcagctttgatgtcaacggtttcgtccgcttcgtcagaaattagacaaacttaagccctaaaaagaccgggtgtttgagacccggcctttcgtcatattatgcttccttcaacagttcttctatcactttatgttcgttttcattcaacagattttttggaatgatccgatctatcggtttattcatatgctgatcgagaatatcggctgtttctttgtcccctgcgattacgagacgctcccattggtgtgaagcggccttttgatcaaggtttgaagccaatcgtttatacagcctgttttggttttcttcgacatgggctttggcggcgtcttcgtccattgatgcggagcttccgcttacatcctgcggtttccacgattcattgatgacgtcgtattgataatgctccaccccttcaatttttccgagtacggtttctatgatcttcacttcattctgctgggtgagaataaaagccgtgcttggaaattgttcacggagaagttctaattgatcaaggacagccgtttcttcccaataaaatcgtgtttcgacaggcacctgcaattcaatcgtctcccagacaccgccttcccccgatgcaaaaaatacgaggcttcgcggcatctctttaccaagcccatcgatatattgatagacacgttgcatgatgcggacgagagatttttcttcttccggatcacttacagacagatactcttttaatctccgaaaaccggttttcaaggcgattttccactctcccccctgctgatccggatttctcatatccgtatttacatataaggaaagcattttatcaggagattccgtcattacgtacttcaatttgccgatgagtgagtcaattgccattatagattcctcctttttccgctgctcactgttcctttccctatccccaccgccttaaaaacgtcaatccacatataaacggcagacttttctaaaaaagtttttgcaaaacccatttacaaaccaagacatcatttactacaatggatacttgtgtttgactaagacttttacgctgtgaaaggagtatgattttgtttactgcagaagaaagagatcagaaagagctggaaaaagagcttcataaacttgaatttcagattttcagaatgcgggaaaatctgatagatgtatcaaaagacgcgcgagtgcttggtattgatcaatcgaacaatgacgattggatcattgtttcctcgattgatgatggccaaacatgtaagattatgctgactgattgtgaatcagcctaccggggaagaggctgtttttcactgatcgcttcttattatgacaatgccattcatatcggggatattaaaggcccgccgaaccacggctacggctcgatctgcatgaaatttttaaaacatatcgccagagagcagaatatcccgaaagtgacgggcgacatcgctaagcgtgattgggatcatgtcgaccggctcgttcatttttatgaaaagcatcaatttgatgtctggattgacaatgatacgcaatcaggcggcattaaatgggtcgacctgtaaaaaatgatagataaaccctcgttaatatggtgtaatagattaaaccatttaaggagggttttttttgtatccggaaaaattgaaaaaaggcgacggcatccgtattgtgtctccggccacaagcatgtccgctatgtcagatgaaaatataaatgccgcgaagacaaaattggaggagctgggcttttgtgtctctttttcagagaatgcgaaagaaataaatgaatttcattcatcatcgattgaatcgcgtgtacgggatctgcacgaagctttcgctgatcctgacatcaaagcgattttgacgacactcggcgggttccaatcaaatcagctgctccgctacgttgattatgaaaacatcaagcggcatccgaaaatcctttgcggctattcagatattaccgctctcggccatgccatatatcaaaaaaccggccttattacatattccggtccccatttttcttcatttgccatgaaaaaagggctggactatacgattgactctttcttggcctgctgtgcttctgacaacccgtatgaggtaaaaccttcatccgagtggagtgatgataaatggtatttgaaccaggaggacagacgtttttatcggaatccgggaccgctcgttattcagcccggatatgcggaaggaacactgatcggaggaaatctatgcacgctgaatcttctgcagggcaccgaatactttccggagatggaacaagtgattctgtttatagaagatgatcatatgtcggacattcatatgtttgaccgggatttgcagtcactcatccatcttcccgctttttcagccgtgaagggaattgtcatcggacgtttccagcatgcttcaaatgtgtctgaggaggctctgcgtgccgtcatccgtacaaaagaagaactgtcatccatgcctgttatcgcaaatgctgatttcggccatacctcccctttgatgacattcccgatcggaggagcatgcaggatagaagccggctcagaaggcggacggatatggatcgatcggcattaatacataaagacgggaaaaccgccccgtctttttattttgacgccttatgccgcggcgtgcgaggagcgatcataattcgtccgccagccgctgccctcacccatacggaagctccttcataaaaacggctgatctcttcattatatacggcgtgtgtcagttcacgtttatcatgcgttccgtcttggttttttacgtttaaaataagtacaagctcgtgcctgccattcttcatcacgccagtacgtctcaccttttcaataacggctggccttcctctccctctgtcaagcgcctgaaacagcctgacagcaggcatagacagtccgataacgagcacaatggcgaaagcggtgcatatacctgcttgaaacaccggtgattctgtgaaggtattccataaacatatacattccggctccatcagattcatcccttccgattcttttttcacatccattccttattatattagagaaacgctttttctttttccgcatataacgattatatacagtcaaaaaagggaagaaaaaaagaacacaaagcatttcgccttgtgttcttcatctctatatgaaactagtctaatactttaacatttactgttctgacgccccagttgttagcgtcacttttctttgcaacaaatacgtcaattttatttcctttaattgcgccgcctgtatctgctgctgttgccactccgtaaccttcaacataaaccttagagccaagcggaatgacactagggtctaccgcgatgacttttgcatcagggtttttgtttaagtcaacaccggttgccgttacaccggaaatgccgccgtcgttagcagagtaagcagttgcagtcattgtcatctgctttttaggctcttgttggtttgtatttgattgaacaggctgctgttttgcttcgacagccttcgcttcttgtttaggttgttgttgttcttgaacaggttcttgtttaggctgctcgtttttgacagcttcttgtttcggctgttctgtctcagcagctggtttttgttcagtttgcggctggctggcttcttgagccggctgtgcagcctgagcctgagcctgacctttcacatttaacgttgtgcctgcgtaaattatatctgattgcaagttattcaagcttttcagattgccgactgatgttccgaatttctgagcaattttccagaggctgtcgccctgcttcactgtgtactgcccagatgtggttgtttctactgaagaaatagtcagtttctctccttcaatgattaaatcagaagataactgattccattcttttaagtcctttaggttcactccgtttttttgcgagatcccccagagcgtgtcacccttttgcaccgtgatttctttagcagaagcgtgagctccaaatgcagttgttgaaattgctgcaactgcgacaaaggacataatcgtcttcttcataagtaaatcctcccttgttagctttttattggcggctaacaggtgatatcgtaacatatgaaaatgtcagttcaataacaaaacgatttgaattagattacagttcctttacatgaaacatttctctcgcttggtaagtcttgctgaaaccttgatacagcaagggttttcaagcttctgatttttccggcgcccatgaaaaacacaatgtgcaaatttctaaaaaaactttttttcactctgtttctcttacataatttcggatttcttctaaaaaaaccgctccgtatttcaatcttttttgttccccgaccccttttacggaaagaagatcctgatctgttttcggaagtttcgccgacatttcttttaacgtctgatctgagaacacgacaaatggaggcacaccctgttcagctgcaatctctttgcggagacgccggagaagctcaaataattcatcattttcggtgacggcggcggcctgtaaggcttcttttctcgcgactgcgctttttccaagcagaacgtccctgcctttttgggtgaccataagcgtgggaaatgtgccgtccgccattctgatatattcatctgaaataagaaattcgataaaatcactgatttccgctgcggattgatgcttcataatgccgtaagtggacaggctgctgaagccgttttccagcacttttttatttttagacccgctaagcacctgcgccaccatcgtttttccgaagcgctcattcattctgatgatgcatgacaataccatctgcgcttcttttgtaacgtcatgggcggtccttgtatcagtgcaattgccgcacgcttcgcaagcttccgcctcattctcgccgaaatacttcagaataaaccgctgcaggcaatcttccgtatgacagtaatccaccatctgtctcagttttttgagatcctgcttttgtttttcttctccggcggccgattggtctattaaaaaacgctgcaccataatatcctgcggcgaaaataagagcacacactcgctgttaagaccgtcgcgcccggcccgtccggcttcctggtaatagctctccatatctttcggaatctgcgcgtgtaaaacaaacctgatgttgctcttatcgattcccattccgaaagcggacgtagctaccatcacttgtatctgatcgttaagaaaacgctcctgctggtcttttctgtcatcatccgccaatccgccgtgataacggccggcattgatgccgctgcgttttaatttctcatataaacggtcggtttcttttcttgtcgctgtatatataatgccggcttcgtgtttatttttttcgaggtaccgctcgataaaccggtctttgttttcgccctttactactttaaacgttaaattctctctggcaaaaccggtatatacagtttgttctttcttaatatgaagctgcttgcagatgtcatcatgaacctcaggcgtagccgtcgccgttaaggcgatgatgacgggcggttcttttaattcattaaaaaggatttcgatattccggtaactcggcctgaaatcatgtccccattgcgatatacagtgagcttcgtcaattgcgacaagaggaaccgtaatattctgcaggatgtgaatgaattcagaagaagtcaaacgctccggtgtgatgtaaaagagccggtaagccccttgtttcaaaccggtcaggcgctcatgaatgtcacggcttgtctgggtgctgttaatataagctgccgcgatacccgcttcttcaagcgcgtcgacttgatctttcattaaggaaataagaggggaaataacgattgtggttccttcaaacagcagtgcgggaatctgatagcagattgattttccgccccccgtcggcataatgcagaccgtgttttttctctcctctgcaactgattgtatcgcctgcttttggcccgcgcgaagactgtcgtagccaaaataatgcgccagaagggattgggctttatccagcatatgttgtaaaacctcactttgtctttgattctttcattttatcatactgataaagtacgctgctcaagggcaattcaaaataaaaagccatctccgcaagggaaatggctttcgctacgtatgccgtacgcaagtaagaaagttttaaaccaccactcctcaaagtgggtgtttgcagaagcgttcctgtcgtcctctgcaatggaggcatgacattccggcttcgatataaaactccctattacagcttaaaggttaaaacttaattaacaatacgaacaatgtagcttctcttatatcctacaccatcagtcgtattttggcaagagggttaattcttttacagaaaaccttttttctttgtgaaaaatgctttattctacataaaaattgttttttcgacaaaatatcaatatatcaatataagattgaatcgaaagctgccgccagtttcttctataatagaaaaaactctcacaccctgtaggggcgcaagagttatggcaattagaattttgcagccagatctttcgcttcttgcagtcctttttcaatgatcgcttgagcgttatccggtgcagcattatgaccttcaacgacaacagtgtgaagatcttggacaccccagaaaccaagaacggttttcatgaagtttaatgacatttcaagagatgccatcggtccttcagaatatacgccgccgcgtgcgtttaagagcgctacttttttatctcccatcagacctttagggccttcaggcgtgtatgtgaaagtaacccctgcgcgagacaggtaatcaacataagtatgaagcacagcaggcactgtgaagttccaaagcgggaatgcaaacacgactttgtcagctttaacaaattgatttaagtaaatgtcagcagttgacgcttgttttttctcttcgtctgtcatttcaattcctttagaagctttgaatgttccgttaatcatatctcttccgaggtaaggaaggttttctttatgaagatcaagttcgatcacttcatcattcggattgttttctttataagcagccagaaacgcttcgtataattttacggatacgccttcttcagccgtacggtcgcttgattttacaaataatacttgagacattctaaattcctcccggtaatcttttaatatttacttacaaatagtatgttactttcttttttatataaagtcaatgattttatttcgattctgagattttttatggaataaaaaaacaggtacatatgaatgtacctgctgctattattgtgaatcctgctcgcgatccaggatttcgtaagtttgtgagcttttttgatcaacggtttctttatttgagaggtctttcacctgctcgtgaaattccctttcatatgacggagcgtctgttttcacatccccttctgtttctcgctgcgcttcgacggtcattctggcgtacggtacggcttcaagtctttcataaggaatttcttttcccgttttctcgcaaatcccgtatgttcctttatccattcgttcaagcgcggcgttcacctcatctaaaagattctgatcgacaccgtccagcgtctgattcgtgaccctgtccaaataaatgcttccgtgatcagctaagtgattatctactccgttcgacagttctcctgtgtcttcgctcattgaatgattttctttggattctccctgaagactttcctttaaatcgattaatttatgataaaggctgtcctgctgttcttttgataatgccatattcatcatctcctttttcgtctgtattcttcgctgcatctgttaatacataccctcgaaaaaggaggatgaaacaatgggggtcaatgctttctccccctgatggtgacattgggtgtctgctgctttgtctgtcttttttctttcgcagcatcattttgcgggttgtcccgactttcttcagcgcaggcttgtttgagcctgtgcgccggtgtatggtaagtggcgccgatattcagcataccgctcagctcttctatactcagctgttcaaaatcaatattgtattcaatcttgtccactttgacgtgctcaatatggacatatgttttttccccttcaaccgtttgcggctcaaaatgacacttatcctgaagctcatcaagctgttgttccactttcttaagccggtctaattcttcttcacacacttttttgaaaatctctttcattatttttttcaaagaaaatcacttctttccccgtcactcttggaaagttctatgcgtcccgtattgcgaatatataaacatgatatacaaaaaggaggcgaatcatgatgttttttccatccgttatcaactttgagtatataaaaatgaacggaatcagcggcggagcggcttttaacaccggctcttccgttatggtgagaaacacagcagccaataaaagaaatgaagggtacggtgaacaaaacggtgattgcaccgttgtcgccatccctatcatgagtatcgatgattcagatctgatagatggcacagcgaacaagatcagccttcgataatgatctggcttgcatcccccagatgtttagcaatcgatatatataaaatcccgtctttgaataccgcctgcattcccttcgtaccttgagcggaatgcggaagatcgagttttttttcaaaatcgccgtattttccggtcttctgtttaaaatcctgttcattgaaaaaggattttctcgtgccttttacgacaatatattctccgtaggacaacagctgaacatcttgtttccggtagccgggcagatacagcaaaaattggagctcatcatgggtttccacaatatctataagaggaaaagcatcctcatttcttctcatttgcccatctccctgttgaaagggaaaatgagaatggccgttttgaaatgatttcagttgttcatcatcaaaaacgtttttccaaaagtcgccgccggacatgttttgcgccatttccatccattgcttcatcttatcgaaatccatttttatcgccccctgtctaagcatacggtcataacagccggcatacacctgtattaaaggaggtttgcctgtggttcaaccaactccatatatcaatattaatattttcatgttgaaaattaattcctttgaaaatgcttcagcggtgaatgtcggacaaaatttactggcggaatggcagaattctgataaaaagaatcagggatacggacagaacttcggagatgcaagcggcttcatcggcacgaacggcaaagtggatgaccgggatcaaattgattctccatcaacctttgagtctgcatgcgacaaaatccctgccggaaaaggaggcccattatgatgttttcgccggttttggtaaatgtaggaggctttaaagtaaatgcggtcgaccgcggttcttccattacgatcggcccgtatcagcaaatcgattattttttatccaataagatcaactacggattcggtgaagaaaatggtgatttggcgccgatttatatccccatcagttctatcgctgacccggatctcattgattcgaactccggaaaaacaagcattatataataaaaaggccatccgcatgcattcggatggcttttatgtgatatttaactgcataagtattttgttaagatggcttgaacctcagtcaagtccgtttcttttgcaaattccaattcgaaagtttttccccttgtcattaatacaagcccggtatcgggatcaaacatccccgcttcttgaatggcgaagctttcaattgttttatatggaagaaatacgcgcactttctttttggagaacattttattatcaaagaaaatcactcgtttattcgtaaagcatatttggtcaacccgcagtttataaatcgtttcgatccgttctccctcaacgagcaaagcctccagcttttttgtgtcggttgatctgctgacagaaaaaattcccaatgaagaaccccactttctgcttctatactattgttttattacaatcataaaaaataagttctttatccctatataagaatacgacatagacggcatttaaaccattacgaacagattacatttttagaacgttcatcaaaaaagcccttcgcgaaaggtgccgcagttatgaagtaatacggttcagcggaagaaaaggtttcaagaaaacggtatttttttcgaaaagtcagttttttattttcgccataaaaaaccgcggcttctccaatgccgcggtttcaacaaaacatcaacgatccgtatcttcaattgttccttctttataggtatctgaaatttgttccatcgtcgtgtcggtgccttcttcaggttgcacttgctgaagctgatctgatgttttattttgtttgtcttgctctgtttttttcattttgcagccaccctttatatgtagtcttttttagtatggctcaggcaaaatgaattcattcagccttaaacttcttcaaaatactctttgtagaagcctccgactttgtttgtattgtctgcaacaaaaatgaattcttctgtttcatttttgacttcatactctttacccggcgtcagcacatttttgacaatgtattttttcgcatctgtatgtacgcatttgacctttttgacgctttcttttgtctgccaattattatgaatcatttataaaactccttttcttaatcgataagcttattgtagccgttttttcttgtgaattgcaataacggttatcgattgattttaccgggggtgttattatagaatgactgtatgcgcttactttgcgcggacatcaagatgctcaaaacagaccataaaaaatttcgggaggtttgttacgaatgagttctttaacgatgcagatcacaaaaaggctggaaacatttttacagggtacgaagaaactttatattgacggaaaatttgttccgagcgcttcaggatcaacatttgtcacaccgaatccggcaaccggagaaacgctgatgacgctttacgaggcacagacagaagacattgacagtgcagtgaaagcggcacgcaaagcctttgatcacggcgaatggcgcactatgccggccgcttccagaagcaggctgatgtataagcttgccgatttaatggaagagcacaaaacggaactcgcgcagcttgaaacacttgataacggaaaaccgattaatgaaacgacgaatggggatatcccgctcgcaattgagcatatgcgttattatgccgggtggtctacaaagataaccggacaaacgattccggtcgccggctcatattttaattacacccgccatgagcctgtcggcgtcgtggggcagatcatcccttggaactttccgctccttatggcgatgtggaaaatgggcgccgcccttgccacaggctgcacaatcgttttgaaaccggcggagcagacaccgctgaccgccctctatttagcggaattaatagatcaggcgggcttccctgacggcgtcatcaatattgtcccagggttcggcgagacggccggggaagcgctgaccaaccatgacgatgtcgataaactcgcttttaccggttctacagaaatcggcaaaaaaatcatggaaaaagccgcaaaaaaaattaaacgcgtgacactggagcttggcggaaagtcacctaacatcattttgcctgatgccaatttgaagaaagccattcccggcgctttaaacggggtcatgtttaatcagggacaggtatgctgcgcaggctcccgtgtcttcattcacaaagacaaatatgatgaggtcgtcagcgaaatggtttcatatgcgaaatcgcttcagcaaggcgccggccttcaccaagatacacaaatcggcccgctcgtcagccaggaacagcatgagcgcgtgctttcatatattgaaaaaggaaaagcggaaggagccaaagctgtcgcgggcggcagctgcccgtttgaagaagggtattttgtctccccgactgtatttgcggatgtggatgacagcatgaccatcgcaaaagaagaaattttcggcccggtcttagccgccattccgtatgatacggttgatgaagtcattgagcgggcgaaccgctcggaatacggtcttgcagccggactttggactgaaaatgtgaaaaacgctcattacattgctgaccgtctccaagccggcaccgtttgggtcaactgctacaatgttttcgatgcggcatctcctttcggcggctataagcaatccggcctcgggcgggaaatgggctcttacgcgctgaataattatacagaagtgaaaagcgtctggatcaacctggaagattaaatcaaacaagaaactgctgcctgtcagcagtttctttcttttgtcatgccgccttttacatatgaatatatatgcttctgaaggagttgagcgagtgtgagcacaattcatgaaaacgtcagaagccgccaaaagaaaaccatctccctattaagagaaacgcaaaatgcggacggctcatggtcattttgttttgaaggtccgattttgacaaacgcctttctgatcctccttctcacttctcttggagacaatgataaagaactgatcgctgagcttgcagaaggcattcgcgctaaacagcgcccggacggaacttttgccaactatcctgatgaccggaaaggaaatgtgaccgctactgtacagggctatgccggcttgctggcttccggtttatatagccgttctgaggcgcatatgattcaggctgaacgctttatcatctcaaatggcggcttgcgcaacgtacacttcatgacaaagtggatgcttgcggcaaacggcctttacccatggcccgcgctgcatctgccattatctttcttagtcattcccccatccttcccgctgcatttttaccagttcagtacatacgctcgtattcatttcgtaccgatggccgtgacgcttaacaaaagattttcgctgaaaaatcccaatgttccgtctctcgcgcatttagatcggcatatgactaaaaatccgtttacatggcttcgttccgatcatgatgagaacagagacctctcttctcttttcgcgcactggaagcggcttttgcagattcctgccgcttttcaccagctcggtctgcgtacggccaaaacgtatatgcttgaccggattgaagaagacggcacattatacagctatgcgagtgccactatttttatggtgtacggcctgctcgctctcggtgtatcgcgccactcccccgttatcagaaaagcgcttgccggcacgaaagctttgctcacgtcttgcagcgatataccgtacctggaaaattcaacgtcgaccgtttgggatacggcgcttctcagctatgcgcttatgaaaagcggcatctcagataacgatcaaatgataaccggagccgcccggtttctgcgtgaacggcagcagacgaaagtcgctgattgggccgttcacaacccgcatgctgaaccgggaggatggggtttttcaaacattaatacaaataatcctgattgtgatgacacagccgcagtgctcaaagccatcccgcgaaaacgttatcccgcctcatgggaacgcggactgagctggcttttgtccatgcaaaacagtgacggcggcttctctgcttttgagaaaaatgtcaatcatccgctggtccgcctgctgccgctggaatcggctgaggaagctgccatcgatccttcaacaagcgacttaaccggacgggtgctgcactgtttaggagaagcggggctttctcctgatcaccctcagattgaaaaggccgtccaatggctgatccgccatcaagaagaggacggatcgtggtacggcagatggggtgtctgctatatttacggcacatgggcagcgctgacagggatgaaggcttgcggcgtgagccaaaaccacccggccgtgaaaaaagcgatccgctggctgaagtccattcaaaacgaggacggaagctggggagaatcctgtaaaagcgcagaagtcaaaacctatgttccgctttcttacgggacgcttgtacagacggcttgggcggccgaagctttgctgcaatacgaaaaacctcatcatcaagccgtcacaaaaggcatatcttttcttattgaaaaccggcattacgaaggagacgctttcagctatccgaccggaatcggcctgccgaaacagttttacatcaggtatcacagctacccgtatgtgttttctttgcttgcgctcagcacttttatgaaagtgagtgaaaaggaggaagaaaaatgaaacggcacgcttatcaaaccgaaatgctgaattggtgtgaaaccttgaaggaacaagtcatacagcaaggtcggttcgatcgcttcgcggcacaaatcgaccggatttttcacacccttcaggatgatggattaacggaggcggaatggtacgaacaggcatcagcactttaccgggacattaccgaaccggaagagccggatgagcgcagagcctatgtgccgatcggcaagcatgtcctccctaaactgccatacagttattccgcactggaaccgtatatttcaagagagattatgaaactccaccatactaaacaccatcagagctatgttgacggtctgaataaagcagaactggagctcaaaaaagcgagacaaacgaaacagtacgacttagtggcgcattgggagcggcaattggcgtttcacggtgccggccattatttgcacagtattttttggttttccatgaatccaaacggaaaaagacggccgacgggtgcgctctttcaaatgattgatgtgtcattcggaagctattccgcttttaaagagcaattttctcaagcagcaaaaaaagtcgaaggagtcggctgggctatccttgtctgggcgccgcgctccgggcggctggagattttggccgctgagaagcatcagctctacagccaatgggacgtcattcctttgcttccgctggatgtatgggaacacgcctattatttacaatataaaaacgaccgcgcggcttacgtggatcaatggtggaatgtcgttgattggcgggaggcggagaaacggttcgagcaagcgcaccgcgtgatgtggccgctttattaaaaaaggcccccgtcttgaacgggggcctgcttcttttggtctaaaaaataccaagcacgtgcagaaaaacgataataatggctacaggagccacataacggattaataggagccagactgcaaaccattttcgttttataccggaaccgcttttcagttcgtcaaacagcatctgtttcggaattttcagcggtacgaacacggcaattaaaagcgcgcccaacggcattaagacattgctgaccagaaaatccgcagcgtcaaaaatactgcggtgaaaaatagaaacatcactcaaaatgccgtacgacagcgccgaagggaccccgacaataaatatagcaagtcccccgatccatgcataccgcttccgttttgccgaatcgccttttgacaaaacagcaactaaaatttcaagcattgaaaaagccgatgtcagcgtcgcaaataaaaacagcagcaaaaaggcgagtaaaaacacgatgcccaacggcatttggttaaagacggtcggcagcacgttaaataaaagctgcggaccttgatccggcttgagaccgaatgcaaataccgccggaaaaatcgccactcccgccatcacggcaacaaggacatttaataccgtcaccgatacggcggattgaacaatattttcttctttttctaaatatgcgctgtatgtaaccattacggacactccgacgcttaacgagaaaaatgattgacccatcgcatataaaatggtattggcatccatcgcgccaaaatcaggcatgaagaagaattttaatcccttcgctgcatcatgcagcgtaacggagcggatcattaaaagaataaacagaataaacagagccggcatcagcacctggcttaccttttcgatgccgctgctcaccccttttgccacaactaaaatcgtcagcacgataaacagcagctgaccgaaaaccgctgcataagggtttgaaatggtatcgataaataacgtatcaaatcccgaagaaagcgttaaaccgcctgtaaagccttttataatgtagattaatatccatccccccactacgctgtagaaggataatagaataaaacacgttatgattccgagatatccgatccagtgccactttttccccggcgccagcgccttataggattcaacggcgtttttttgtgtttttctgccgataataaattcagcaagcaaaagcggcagtccgattaaaacagtaaataaaataaaaacaagcagaaaagcgccgcctccgctggttcccgctacgtaagggaacttccatattgcgccgagcccgattgcagagccggccgtagctaaaataaatcccagcttagatgaccattgattagcttctttcacttcagcactcccaattcatttcagtataaaaatcaattgtaagaatatatgtctgaatagtcaagaagatattagtttacataataattttatcgaaaacttatatttaatattgaattattcagaatattatttataatggagtacagaaaagtcagtcatattttctgactgattgattggatgtaaaaggagctgtgtttatggaatggctgaaaaaaataagcgggtttgcgggccaaacctttggcttgtgggttatcgtctttgccggtttgggattcgcctgccctgatttgttttcttggatcagttcttatatgacgattttccttggtattattatgtttgggatggggcttactcttcaagcagacgattttaaagaattaatcagaaagccttggcatgtcgtgatcggagtcgctgcccagtttacgattatgccgcttgcggctttctgtttatcagtcgggctccgcctccccgcagaaatcgccgcgggcgtcattctggtcggatgctgtccgggcggtacggcatcaaatgtcatgacgtttttggcgaaaggcaatacggcgctttctgttgcggtcaccacgatctcaacattgcttgctcctattgtaacgccggcacttattatgctgtttgcgaaagagtggcttcccgtttctttcggttcactgtttgtttccattatgcaagccgtgcttttgccgatcgtcctcggggtgattgtgaagctgttcttcaaaaaacaggtcggacaagccgtgcacgcacttcctctcgtatcggtaatcggcatcgtagcgattgtatcctctgtcgtcagcgtaaatcgtgagcatctgcttcaatccggactgctgattgtgtctgtcgtcatcttacataacggaatcggatatttgttaggattcctgactgcaaagctgttcagaatggattatgcttcacaaaaagcgattgcgatagaagtcggaatgcaaaactccggactgggcgcagcgcttgcgacagcgcatttctcccctttgtcagccgtgccgagcgcaattttcagcatatggcacaatctgtcggggtctgttcttgccacctactggtctaagaaaaaagagaaaaacagcgccgaagaagaaacggcaaagattccgttttcataactgaacaaggataggctgccgccgctcctatccttgattattctgcagatcacgaaacaggcgcaaaagcgctttttttacatccccctgaaataaacctccatgataacaaatcaattggcggatatcgtaatcaagcagccgctgcacagatcggaccgcatcatccatatgtaacgtatagtcaggattagcaagtttcagctttccgtcttcaatgacgaccgcatcacctgtgatcattgttttttcggcaggcagataaagactgatatggccgggtgtatgacccggcgtggctacaacgcgaatgcctccgcaccaaggcagcagctcaccgtcagtaactgtccggtgaactggagccgattcgactgattgaagcgagcaaatgaactgttttgcataaggctttgcatcctctggcaatgaactaaacgttgattcagcctgctcaagccgtaaagattttttagagccgtcaatatacggcgcttcacgctcatgtactgtcacgctgatatccgggtgcaaacgatgtaatgcagcgagtgagccgatatggtctatgtcgtgatgcgttacaatgatttttgtcaatgaatgaagcgacattccatgccgggcagcagcatgttgaagatggtttgtaaaaccgggatatccgcagtctattaatatcgtgtcatgttcgtcttgcagaagaaccggagtgatagaatgcaattcttcattatattcaaattcgatctcaagcggataacagcttttcatataaattctccccttcgctcaataaaaaagtacactgcttgtaagggcagtgtactttttgtctgtttcaaattatccttccagcagcagctgttccggatcttcaagcaggtttttaatggtgacaaggaacccgaccgcttctttaccatctacaattctgtgatcatatgataaagcgatgtacatcatcggacggttttcagagcgctccgcatcaattgctactgggcgcagctgaattttgtgcatacctaagatcccgacctgagggctgtttaggatcggtgttgacataagcgatccgaatgtacctccgtttgtgatcgtgaaggagcctccttgcagctcacctaatgttaatttattgtttcgcgctttcttcgcaagttcgccgatctctctttcaatgccggcaaacgtcaggcggtcagcgtcacgtacgactgggacgacaagcccttcttcagccgcgacagcgataccgatgtcatagaattttttcacgatcagctcatcgccttgaatttcagcgttaaggagcgggaattttttcaatgcagccacgacggcttttgtaaagaacgacatgaaaccgagttttacatcgttttgctcaaggaattggtctttacggcgttttcttagattcataacggccgtcatgtcaacttcgttaaatgtagtcagcatcgcagaagtctgctgcacttcaaccaatcgtttcgcgatcgtctgtctgcggcgggacattttttgcacttcgacaggtttgtcaaagctttgctgtgttttttgagcctgctgtttcggctgtgccgcaggttttgaagccggtttttcataagcttccacatcttgtttgcgcacgcggccgagcgggtcccccgtcggaatttgtgatagatcaatccctttttcccttgccagcttgcgtgcagccggagacgctaccgttctggatttcgcttctgattgtgcttcctggctgacttcttgtgcagcaggttcagcttttgcttcctctttcgtttgttcattggctggagcactttctgaaggggcgggtgcagaactttcgccagcgccttctgtaatggtaccgataatttctcctacttggacggtatcacccgaatctttcaatacctcttttagaacacccgattcttctgctgtcaattcaacatttactttgtccgtctccagttcaagcaagtactcaccctgttctacataatcaccgggctgctttaaccattgggctatcgttccttctgagattgattctgctaattcaggtaccttaatttccgccatttttacatttcccccttagtttttgcgagtcaagctatcagatacaatgcgttcctgttcttttttgtggactgtcggatctccttctgcgggactggatcgtcttcttcggccgatgtattggacatttactccttttggcgcaatttccgtcagatacgggctgatataactccatgcccccatgttctgcggttcttcctgaacccaaacgatctcttgcaggttcggcagtttggcgaaaagctccttcgtatcttttgccgggaacggatacagctgttcgattctggcaatatgaagccaatccttatcgccttccattttgttgaagtgatcgctgatatcaattgacacttttccgcttgataatacgacgcgagtcactttttcgtaagcatgggaaagaccggactgctcatagacaggcttgaatcggctttcgctcagttcctgcacttcagataccgtattcgggttgcgcagcaagctcttcggcgtcatgatcacaagcgggcggatttcctcacgaagcagcattttcgcttgtcttcttaaaatgtggaaatactgagccgcacttgtcaggttggccactgtccagttgttttccgccgccagctgcaggaaccgctcgacgcggccgctggagtgttcagggccctgcccttcgtaaccgtgaggcagcagcatgaccagccctgatttttgtccccattttgcccgtcctgcagatatgaattgatcaaaatagacttgagccgcattggcaaagtccccgtactgcgcctcccacaacacaagcgtttcaggcgaatacacgttgtatccatattcaaagccgagaaccgatccttcagagagcgggctgttatgcaccgtaaatgaagaagcgcagtcgtctaagtgatggagagcaacaaattcttctcctgtttcgctgtcatgcagcacaaggtttctttgagcgaacgttccgcgctctgaatcctgcccggtcagccggatcggcgtgccgtctttcaaaatggaagcaaacgcaagcgattcagccaatgaccattcaactttacggtcatcatcaaacgcttttgcacgtctttccaggattcttttcagtttgccgaacacgttaaaggattccggccagttgataagttcgccattcagcttgcggagaacatcaaaatcaatggctgtgtcaacgtctggaaaaccgttggacaccggctccggcaattcaatttcccgtacggcgtcttcttttttggcgggcacctttttataggcgtcttcaattcgttttgtcactgccatttcgatgttttgcgctttttcctcgctgatcagtccttcacttacgagtttttccgcaaagatccgcttgacagtcgggtgttttctgacggcatcatacagcatcggctgtgtcgttgacggctcatccatttcattgtggccgtatcgtctgtacccgattaaatcgattaagaaatctttattgaaccgcttccggtattcaaccgcaaatttaacggctgacaggcatgcttccggatcatccgcgttgacgtgaacgatcggaatttcatagcccttcgccaaatcactggcatattttgtggatcgtgattcatcgctttcagttgtaaagccgatcatattattggcgatgatatgaatggccccgcccacctgatagcctttcagtgagcttaagttcagcgtctcggcgacaatgccttctcccgggaacgctgcgtcaccgtgaattaaaatggcgagcgattttgtttcgtcttgaaccgggtaccccttttgcgttcttgtttcctgtgccgcccgcgtgcttccttccacaatcggattgatgaattccaagtggctcgggttatttgcaagcgtaatccgcgcgcttttggtttcagcatcctgaagctgtctgtctgcaccgaggtggtatttaacatcgcccgtccagccgtagctgatgccggtcgatccttcagacggcacaaggtctttattcggcgcgtgctggaattctgagaaaataatctcatacggtttgccgagcacatgcgcaagcacatttaaacggcctctgtgcgccatcccgatattgacattggttgtgcccgccttcacagactgggcgataatgtcgtcaagaaccggcacaagcgcgtctaatccctcaattgagaaacgcttctgaccgacgaatgtccggtgtaaaaattgttcaaatccttctacttccgtcagtctttctaaaacggctgacagtttttccggtgaatttttccggaacagttcgccggattcgaccatttttgtaatccatgcgcgctcttcgaaatcatgcacatggtcaaactcgaaagagatggttcttttataggtattgcgtaaatgctggatggcttctaagccgtttgttatattggcaggtgcgtctttacagatgacagacgcgggtattgctttcatttcttcttctgtaagcccgtactcggataacggaaagagctcgctctttttcggatcctttctgagcggattgacggaagcgttcagatggccataggttcgaatatcttctgcaagtttaactgctgctgcgatcttttgaatcagatctgcggtgacgcgtccctgttcctttgtttccgatgcctcttttatttggcttggcggagcgcctagttcgtcaaacatgtctttcagatccggatcaatgctgtctggatcttcagcatattggtcgtacagctccagtgcgtagccgaggttcggtccgtaaaaatcttcccaattcattctttgtttcatattattttgaaacatttgaatattacccccaacctagataatcaagtgatcaattcactatcttgaaataacttttgaacgctgtgcccaaaattatgtaataaaaacgcttccaaggatattttaccactgattgcgtttggattctaccttgattgttcacaaaatagtaaaaaaaacagatcaataccgaaaaaattaaatcattttaaaataaaaagcgaaaaagcataggaaaaagcctatcctatgcttttatgaagcagttttttcaaaagcggatacagcacatcgggcagctgatcgacatccggaacaaaaatactgtactttccgtacatatcctgaatggttttcatctgggattcttctatcgcagtattggacagaaaaacatttatgacttctatccctttttttctcgcttcgatgacagcctcgctcgtatcgacgatgccgttttgttcgtatccgaatgctgccggctctccgtctgaaaacacgattaaaaatttttgcgcctcactccgccgcatcagctgtttcgtcatttgtctgatggcgtatccgtctctgttatcttcttcaggcgcaagctgcatgatcagcggacccgcagcctgcagcagcgactcttcgaacggaatgacggtattgaagaaattcggctggctcgtttcggtcgcttcgtttgtatcctcccaaaatccgacgatttggtgagggacggacactgatttcaaggcttcatgaaaaagaacgatccctctttttgtttcatccattttgtcaaacatgctggccgaacaatcgacaagcaatgtaaaaacggcgtcaatgtctgaagacgggtcctgctttttatagaaaaggcgcgggttccgttccgtaaaatagcggatcagtttgcgattcagccggcctgcgtgaaggtcggtccgcgggagcgtttttttgtgctcaagtgttttttgtatcatctgcttcaggcgtttttgatatgattctatcgtttttgcctgttctttataagactgctcctcttcaggagacgctttttgaggcgtttgataaaccgggaaggcaaatttgttttcttttccgtcagccagcccggcgccctcatgttcatcctgaatggattcaagcgcttccagtttagagtaatcctctcttttcgtctgacgtgcggaaccttgaacggagccgagcgcctggtcaccgtcatcgccttctctggccgcgtctttcccaagatctgatttcgcgccgtgctcaatatcaaattgaaggaagctttttgacggcgcttcggtttcccggtgccacgtattcattttctcttcaaggatttcttcatctccgtcggaagactcagggagcgtgagatcgtcacttaacgaaggcgctttttttacgctttcgaataaaggctcttcagccgctttttcgtaatcaagttccggcagaaaaaagtatgtgttcagcatatctttctcaagcacttcatcaaggccttccatgaggtcttccgttattgttgcgatttgttccgtagaatccgcctcatacacccggatgagctgacgttcaatatacggtatcatcatatcaatattttcatgcatggaaggaatgccttcaagcggagactcagccgtcagcttgacaaacatcgcgcaatacaaagcgtcggtgaaaatgctccgttctaaattcaatgtcagctgcgtcgtgaaatatttcctgtacatctccctccgcttctgaaaaacacgtttcgttcccggccgttcttttttgatctgctcttcaattctgatatcctcaagcagcataaacagctgcttggcaaagctttggcgggtgaagtgccggtgaacgtcatttaaaaaccccgcaaatacccgaaatgagctgctgcgtgttccgacagcgcgcaaatagacatcgcttttcaggccggcttccatatccccggctgatcggtctttccaaaagtggctcatgtaaattttcttttcaaagggattgtagtaagactgcacgccgtattccacttcaacttcactgcttctggtcagtgttttggccagatcagtcagcatcatgaacaaaaacgaatcaatcgtgctgtcgttaaatttgataaacttcattgtatatccctcattcgaacagcgtttctgcaatatttctgacagcggctttttccctgtcgtcgtcaagtttttccacgatgcctctttcaatcgcccgtttcggcgggatgtacgcagccaagtcgcacgtatctatgagagccctgatggacgccgcttcttctgacacttgtccgttatgcgcttgtgcgattaaatcagaagacagcgtcataaagcgctcaattaatttctcatcttttaagacagactgagaggtcagcacctgtttcaggaggcttcctttaatatacggaacatcaatgatgacaaaacggtttttaagggcttcgttcagcggaacggtgccgacgtagccttcattaatcgcggcgataacaccgaatccttcgcttgccttaatcacttctcctgtaaagggatttgtcatcatttttctgtaatcaagcacgccgtttagaatcggaagggtttcaggctttgccatattgatttcatcaatgtataaaaaatgtccctcgttcattgcggttgttacaggtccgggaacgaattcaattgtcgcctgcccctgttcattttcaatcgttttatagccgacaagcgcttctgcatcgaggtctacggagcagttgacgctgtgcatcggtttatgaaaatagttcgaaagcgtttccgccaattttgtttttcccgaacccgtcggtccttttaataagatattttttcccattgtcaaagcgatgacggcatcgaatacaatcgctttatcttcggcctcatagcctgatgatccgattaaatcccggaattcttgggaaacgggatgattttgataagcctgcagtttgttttgtatatcttccggaagtgataggtgctgtaattctgaagtcataggtgatgtttcctttccatttgtattccataaccgagtatactaaaaaagcccttgtatactcaatacaaaagggctcattccctgcgggcgctttttgtcaggggagcgcaggcgattctggctccggaatttccgctcgggtttgttaaataatcgtccgtatgttcatgaatgacgaacgcgcttccgtcccggtcgagcaggctgagtctgctcccttcttttaatgaagtttgcggcgcgttcataatgacatccactttaccgtcagcccccacttcaagattggggagatctccggcgtgatgacccatcggattgttgaagccgtgttctttgttcaaagggttgaacggaccgccggctgattcgaaatcaggtgcctgacatgtccctttttcataaatatgaaatccgagagaagcgccgggcggcagatgtcccgctgatatatgaatgtctgatccttcatcatcagattccctcacttcgatatatccgatcgtttttccgttttgattgatgagtccggcatgctcacggtatgcagatgcttccaatgcgcggctttccccatgttttttgggcggagcaggagcgggtctcgccccgcagccgcaaagcgtaattgatgcgagcatgagaaaaagcaagagacgattcatgcttcctcccccttatttttttacccatcagtcttgtcaaaacgtgaaaatggtaaacaaaaaaagccccgaaaggcttttttttaaaaataactgcgcgctcctaaataagcttttttccaatatggattgcttaagtttgaaatttcaaccccggaggagcttgcgtgaataaaatctcctccgcctaaatacattcccatatgagaagggcccgctttatatgtcgtaaagaagacaaagtcgcctgctgacggctggctgatatgtttcatcgtattccaatatccggccgtgctcagacgggaaacagagcttaccttatttaaaaggtaatagatgtaaccgctgcaatcgaagcccgcaggcgtattgcctccccagcggtaaggcacgccgacatgttttttcgcctcgcctatcattctgtcaatctttgaccctgtcaccggaggttcgggagtatttggcttgtttggctttgccggtttgttacccggctgccgcacaggatcttctgtttttcccgttccgttaatcaacagaacctgtccgatttgaagcacatcagttgtcagtttatttttttctctgatgagctgagcggtgatgccgaaccgattagcaattttccagagggaatcgcctgcttttactttgtaagtggatggcttctcagaagggtttgaatgagatggcggtgttgtgccgctgtttccgttatgtgaagaacctttgatctttaatacttgattcggatacagcatgtctgatgttaattgattcagctttttcagttcggcgatggtgatgccggtttgattggcgattttccacagcgagtcacccggcttcacagtgtaagtccctgatgcgcctttatcaggctttgtctgtctgccgcctccgtccgtgccgccggcagaccctttaattttcagtttttggcccggatagatgatatctgaactcaaacggttcaggcttctcagttcagaaacgctcattcggtattttttagcgatcacccataatgagtctccgtatgtaactgtgtaagcaccagtgtttcgttttcctttttgccccgttttatgtgtgccgctcccgtcgggaatgtgcagccgctgtcctgggtggagtatcgttgatttcagtttattttccgcctgcagggctgaaatacttgtatgatattgccgggaaagcttccaaagagagtcgccgctttttacttgaatggtttttgcttcagcgggatgcacggcgaaggttgaagtcattactgcagatacagccagtccggctgcgatttttttcttcatataacgaaaaacctcctatttatcattgctgaaagggacgttccttttctttggacgccgcctgttatgcaggattcattcagaagtcgacattaattccgattcatttggtcttagatcatcaccaatgccacacattttacataaattgagaacatttcacaaaagactttggaatcattttcataacatggcttttttccgcgacattccacctttcttgtctgtttttcatacaattctcttcacggcgtgaaaatcctcccgaaaaacaaacaaaaaaaagcccgcttcctataaaggaagcgggtgacggctgattacagaacccgggtctcggcagttttcacgtcttctgctatcaattccgctgcacgctgtgctccgccggccgctttcagggattctccgatttcagaagcttttgtctgatattcaggattttcgctcaattcttttattgcttcagtgagcagttccgctgttacatcttcttttttaaacatcttgcccgcgcccgtgttttccacttggcttccgacggcgaactgatctgctcccatcggaatgacgatcatcggggttttgtagtaaagcccttcgctcgtactgttcattccgccgtgagtgataaataagtccgctctcttcaggatctcaagctgcggaacataaggctttacaataacattctcaggaatttcatcaagctccgccggatcaagatgtttgccgattgacatgacggcttttccgttaaagttcctgaccgcttttaagcatttattaaacaattccttctgattgttaaaaatcgtgcccattgaaataaacaggactttttctccttcaagctggtcaaacgggaaatcctgagccgccggcctttcagttatggacggaccgacaaagagataagaatcgccaaactcttcttctttcggctgaaacgctcttgaagtaaatacgatggtttttctgccgtcatttgagaaaatatcatacggcgttttaatgtctgcgctgaattcttcattaagccggctgaccgcttcggtataagccggataatgagatgattcctctgatataaggtttgtatttgaaaacacttctttaataaatgcttcattcattgcaaatgttgtgcaaagtgaatatgccggcagtttcagcttatttctcacaagccttcctgccagaaaatgatgatcataaaggatgtagtcgtatgattcatcttttacttcctcaagaatacggagtgcggctttttcggaagtctcaatcattaacagtaaaaactcggtagcatcccgctgttcatcacccgttgcgttttttccgaattcatcttttcggaaatcttcacattcacggaattccgctccgcttgacgcgattttgtgctcatattccttcacgccgtaatatacgacatgttccccttttgccttcagttcttttacgacgcctaaagacggattgatatggccttctcccggaaagccgatcatcaatacatttgccatctttccactccctattcttttaaattttatgtatatttaaacgataacaccaatacagaaaaaggtaaagatgttcaccttattaatattaaatgggtacaatattcccattttcttattatttcgtatgaagcgcccgcggcgaaacaagcggatacagtccgccgtctttagcaaaagacatttttcccgtttcttctgaaacaacgagcacgagtgcatcagtcacggccgaaagtcccatcgcggccctgtggcgcgtcccgtatttgagatcgacatgttttgttgtgagcggaagcacattggctgctgatacaacccggttttctctgaccaatacggctccgtcatgaagcggattgccgggataaaaaatactctcaattaaagctgaactgatctcggcatgcaggctggtccctttttgtatcattccgtccagcggatctgcacgttcaatcacaatcagcgctccgtgcttttcttccgccagatgctgcacggccctcgccagctctgtataggaaggcgtaaaatgttcgatatatgactgcaggtaaaacgacgaagcgacagcctgcatttcctgaaacgtatgtcccagttcatctaattcgcaaagaaggcattggtctttttcatccaatgtccgcagtatcattccggcatcctcggtaatttgtttcaagtacgtttgaacggcagcggtaaacgcgctttccgtcatttgagtgtggcgcatgtcacatcatctcctttcccttattttctgcatcgcgcgcatggatatgcgccgctgtgtacaccataatcatgaaaggaggcgaaatcatatggaatttgcacggctgatgcaatatatctgcacctttttaggggtcatttcactttcattcatttatgccaagatgtttaaaaagccgaaaccggataaaaaagagtaggccggctttcattgctttttatacataaaatgttataatttctctcgttaaaataaagaaacggggaacctaaattgagagaaacgaacacgatcggccaaaaggtcagacagctgttacatatcttcattccgattttaatcacacaggcgggccttgccctgatcacctttttggacacggtgatgtcagggaaagtgagcgccgccgatttagccggtgttgcaatcggttcaagcctgtggacgccggtgtatacgggccttgcaggaatattaatggccgttacgcccgttgtttcgcagctgtttggagccggcagacaaaaggaagtgccgttttccgtcatccaggccgtttatgtagcggccattctcagtgcggcggttatcctggtcggctttttcaccgttgatatgatcttgggacatttgggcctggaacctcgtgtccggacgatcgccaaacactttttaggctttttatccctcggtatttttcctttgtttgtgtacgccgttttgcgctcgttcattgacgcactcggcaaaacgcgagtcacgatgcttattacgctttgctcattgcctattaattttgttttaaattatgtatttattttcgggaaattcaacatgccggcattgggcggagtcggtgcggggctcgcttccgccctgacttactggtgtatttgcgccgtcagcttttttatcgtcttcagatttgagccgtttgccgggtactctgtatttcggaaactgtaccgtttttctccgtctgaatgcagaaaacttttgaaaatcggtttgcctatcggttttgcggtattttttgaaacgagcatttttgcggctgtcacacttctaatgagccatttccggacggtgacgattgcatcccaccaggcggcaatgaattttgcttccctcttgtatatgctgccgctcagcgtatccatggccatgacgattttagtcggctttgaagcaggcgcaaagcgttacagggatgcccggtcatacagctatatcggcattgtgatggccctttgtttttctttatgcacggcggctttcattttactgttcaggccgcaaatcgccggaatgtatacatcagatccggaggtgctcatgttgacgcagcactttttaatctatgcgctgtttttccagctttctgatgccgtagcagctccgatacaaggcgccctgagaggatataaggatgtcaactatacactcggtgcggcttttgtttcgtattggattatcgggcttccgctcggttacgcagtcggcacttacacgagcctcggggcatacggctactggatcgggttaattgcaggacttgccgcaggagctgtcggtttattcttcagactgatgaagctgcaaaagcgttatgtgaaaaaaatgatgattttataaaggaggagcagcaatgccgaaacataaactgctgtacgattatttaaccgaacgggcggaggatatcagtcagacatggtttgatacccttcatgatacggatcctgattctgtttatgcttctactgacccggctgttctcacaaatctgaaaaaacaaaatctggcgtttaattatcaactcaatcggattttttctgaagagaaggaagtatatacagcggcattggaaaagtgggcgtttgaagccgcacgggataaagaacatttaaaaactcccatccattacatcattcgcgagtttatcagagttcgtgatttgtatgtcggccatgtaaagcagtttaccagacttcattcagacaccgtgacagaagaagatgccgaagatatattccatacgctgattaaatcgtttgatgtggtcattcatattttcatagaggaaatgtataaaaacacaaacattcagcttgaagcgcaaaaagaattgattacagagctgagctcgccggtaattgtgctttttgacaatgtcggactgctgccgctgatcggggatattgacacggcaagagccaaaatgattttggagaatacgctgcaccagtgttcagagaagcgcatcacgcagctgtacattgatttatcaggcgtagccatgattgatacgatggttgcccaacagcttttcaccttaattgaatcactcggaatgctcggcgtgaaagcgacgttatccggaatccgtcctgaaatcgcccaaaccgcggtgcagctcggactgagtttttcaaatttatcaatacggtcttcgcttgcggaagcgatcgcttccgatctgacacaaaaaaagggataaggcatttcagccttatccctttttttatcagtctttccacggatatgtccaatacacttcttcttcaaaccatgtctgaagaaccggctcgttattttttaatttttcttccagctctctcagcatgccttccgtttgggtgcggtgcgcttttaaggcattcattttaatatcggcaacctctttaatatcaagaatgacatcaggcttgccgacggcttcctccctgttgcgggtgattgccatgcaaagcgtgcgcgggcggtcctcttttttctttctgtaaagcgctctgatgaccgcttcgccgcatgcatcatgatccggatggacgccgtgctccggatagaatgtgacaatcagactcggttttacatcgtcgataatctcttccatcatatccgcgagccactcgtcatcttcaaattcaagtgttttatcacgaagcccgagcattctcaggtcagtaatgtccattgctttgcatgcgtcaatcagctcttgctttcttaacagcggcagtgtttcacggttcgcgaaaaagggatctcccatgttccggcccatttcgccaagcgttgcgcatgcatacgtaacgggaatatctttttgtctgtgtaaagcaatcagtcctgccactccgtatgattcatcatcagggtgaggcaggatgacgagtacatgttctttcatgattttcacccttttctttaaactgtaaacggcttttcgctgatttgaagcgaaatcgccaattttccgcccggcagatgccccgccattaacaaacggtcttcttcatctactgtatactcagtcaaaccttctgcgtaaatccagccctcttctgttttcaaaccgacgcggtacgggccgtttcctttgattttcgcctgatggtacgtcacttttgcattgcgtatataggctacaaccgtcatatttttctcattcagatgcgctgaataagaaccggtcgttgtttccaaatggatatatacaggacgatcggcatatcgctctaaagaagtttgcacatcttcttttatgatcgctttcatagctgctcccctctttcttcttttaaaaattgcaaacgcttcgtatgtagttcaaccaattcatatttctcaatcggccgcagccgggaatctacaattcgctgcaccgccagagcaaacttttcctcgggtgacttccggagcctcggatgtgttctttgatcaagcagttcaagatcaatcgccttttccgcttcttcaagggttgaagccgggagagtgcggttattccacagtgcctgataggcttttgctatgtctttatcagtgcccattgtacagctcctttacatactcgtaatgattatacataatttaagctatcgctggaaagcgaaaggcttagcggctttttatcggccgcttccattttatctgtgaaaaggtaaacaaaagcaatgctgcccatatacaaatgaaggtaaacgctttttgcccggaaaacggttcatgatacacaaatacgccaagcataagggtgatggtcggcgctatatattgcaaaatgccgacttgatacagcggcagacgctttgccccctctgcaaacaataacagcggcagggccgtaaatacgcctgcgaaaaataggagcgcccatgttcctgcccccaaggacccaaaagtgctcccgtcagctgtatatcctaaataaataagtgcagccggggtaatcaaaagcgtctccagcgtcagtccgatcgtgctggacatgcgggttctttttttacataagccgtacagaccgaagctgaatgcaagcagcaatgcgatataaggaaccgcgccatattgaaacgcagatatgagcacggccgccccggcaatagaaacggctgctgtttgcatcttgttaagcttttcttttaagaataggatgcccaaaagaacggaaacgagcggattaatgtagtacccgagacttgcttcaagcaaaaagccgtgattgacggcccatatgtacacaaaccaattaacggaaattaaaacggaagcgaaaaaaagcgccagcaggcccccttccgatttcaaaagacgcagttcacgccatccggttttccacttcttaagcacagttaaaagcacacacatgaaaacaaatgaccataaaatccggtgagctaaaatgtccaatgcgggtatttgttcaagaagtttccaatagaccggaaacagcccccacatgacgaaagaacaagcggtataaatgattccttttcttacgttattcccttgcacggccttccccttcctttctgtaaacagattatattatatcacgggaagcttccggcgggcatatactatgttgtccgttaagaaagggtgagatgccgtgtttgattggaacagatattttcccttccaaaatcagttctctaaagaaacgtttaaaaatgctgatccgaaagatgtcgagacatatgtcaaccgagtgatggaaagcgtattcggcgccggttatgccggacagttcccttttcgcgacccgatgtccaaaaaggccgatccggtcgaagcggaaccgcccaagccggaaattgacctgtttgaaacatccgatcatgtttttgcgaaaattcccgccgaacaagaggaactcgaccgtatcaggattaagcatacgtcacacagcctcgttgtagagaacagcagcctgggagaaggaaaaaaagaaatcgtacttccgagcctcgtcaaacggaaaggaacaaaagcagtctataaagacgggatgattgaagttatgttttcaaaacaggaagactacaatctatcggaagtggagattttaagataaaaaaacggcccgcgcgatgcaggccgttttttcttaataaaatggcggataaccgccggctcccggcccgaaaccgccgtatgggacgcctccgtatccgtaaccggcaaacccgtacggatagcggggtcttgtaaaacctgtggcaatcacgcctccgagaagaccgcctaaaaatccgccgaataaaggagcgccgaacaaaaaaggacttctcgccggaaatccggcaggaccgaaattcccgcgatacaatgcatgacgagggtacatgtttttcctcctttatgtctgcctattcttaagcgtattcataaaatgaggaaattgattgggcgattgtaacaacatgtgcctctctttaatattgcattaatatgtaaacattttggttataatttgattatattttgattaactgttatactttttttacaagttacgatattataaaaccatcagggggaataaaatatgccattacttcgttttgacgttattgaaggccgggatgacgcagcattaaaaaagttactggataccgcccattacgccatggttaaagcttttgacgtcccagtaacggaccgttatcagatcgttcaccagcatcggcctcatgagcttatcattgaagataccgggctcggtttcaaaagaagcaaagctcttgtcatcatcagcattgtcagcaaagcgcgcaccgaacatcagaaagaaacgttatatcaactgatggctgatcagcttaaaacagaatgcggcatatcacccgaggacgtcatgatttccgttacagaaaacgggaacgccgattggagcttcgggctcggtgaggctcagtttttaaccgggaaactgtaaaaggcctccctgcttgttttggatgttttcaaactgaataaaagagggatggatgttggttagtgagttgtatccttgtttgatatgcggatttaaaggattagagacaagtcccgtttataacggcgaatatcaaaaaacatttgatatctgcccttgctgcgggtttgaattcggctacagtgaggaccatgacgtaagcttagggtttattgtaacgcctgatcatttaattgaagcggcatttcagttataccggaaacagtggattgagggaggaatggaactattttctccagatgatgttccggcggaatgtaaaaatgatcatttccttacattcgatgctttattaaatcaattaaaaggcttgaacctcaatctgaacaattttgatattaatggtttttatgacgattaaacattatcattaagaaaaggctgccttgggcagcctttattattcatcacatgtgtcgttggcagatcccccgggctcgcaaaaactgtctgcccatttttgcatttcctgaaaaacggcttgcagtgccatgcctttatcagtcagtttataaatgactttgacaggtgtttctggcagcacctgacgctcgacgatttcattttgttccagctctttgagccgctccgcgagcattttttgactgattgtcggtatcgtttcggtcatatctttaaatcgtttcggcccgtccatcagtacatggataatgaggccgttccagcgttttcccaaaagagaaaaagcggattccattttaggacacattgtatatcccacgtgaattcatcccttcatctatgaattgacaagttttttgtgatccattaaaattagttttcaagttacatttagtaagcttctaacttttctattatgataacacgtttatccgaaggaggaaacatgatgacatccgtattagacgttttaaaggaacgcgcatctgttaaagaatacgataaagacgcggtcattacaaaagaggaattgacagaactccttgaaatcacaacgcaagcgccttccgcctggaaccttcagcattggcattttcaagtttttcacagtgatgaagcaaaagctgccctgcttccggttgcttttaatcaaaaacagattattgattcatcagcagttattgccgtattaggcgacttaaaagcaaatgaaaatggtgaagacgtttatgctgaactggctgagcaaggcaatatcacagaagagattaaacaaacgcttttaggccagattaacggtgcataccaaaatgatcagtttgcccgcgattcagcatttttaaacgcttctttagcagcgatgcagctgatgcttgccgctaaagcaaaaggctacgacacttgcgcgatcggcggattcaataaagagcaattcgttaaagaattcgacgtgagcgagcgtttcgtgcccgtcatgctgatttcaatcggtaaagccgttaagccggcgcataaaagcaaccggctgcctgtatctaaagtgtcaacttggctgtaagatgaaagaaacccttagtccgcttaagcagactaagggttttttataggaatcgctcactgtaccaggctcgtgcctgctcggcttcctgctgtgtgagctgatgaccgccctcctgccattcaagagcaacggatgcatgagcatctgtcagatactgataaagctcctccgattcttcttttgtacataggggatcgcgttttcccgcaccgataaacacaggcagcccttccatatcaggcagcttcactccgcgtatcggcaccatcggatgatgcagaaccgctcctttcagtacatctttataatgaaacaaaagacttgctgcaatattggcgccgtttgaatagccggcagcaatcacgttttctctgctgaacccgtacatttgcgccgcttcatcaataaaattctttaattcttccgtccgttcaattaaatctttctcgtcaaataccccttctttcagccgcttaaaaaaacggggcatgccgttttccgacactgatcctctgacccccagcagacttgcgttcggatcgataaaacgtccgagcgacagaagatcatgttcatttcctcccgttccgtgcaaaagcagcagaacattttctgacgttccctgttcaaacacatgtttcatcatcattctcctttctccattatgggcagaacagctgtaatctgactgcgatgctcttccagccattccggaagcttcagctctgttccgagattttcaaaggattcatccgtcataaagcccggttcgtcagttgccatttcaaataaaatgccgccgctttctctgaaatagattgaagtaaagtatgacctgtcaagaatgtcagatgaagcaagatgagaatcagcaagaatatccttccactccgcctgctctttttcgctcgtgcggaaagcgacatgatgaactgtcccgtaaccgccggcacctgcttctttcggcgcaaggtcaacatctataatatgtccgatccttgcctccgattgcagcctgacaatttgattttcttctcctgtctttgaataaccgaagcgttctatgagaaattgaatggttgcttcaggacggtacgagtacagaagaacacctctcatgcctgtgatcgcttctttttcagtaatgcccgaaggagtccattcactctgtccgcttctttcatcttccattatggcaagcggcaggtcttctgtatcattaaagagaaggacttgttcagacagcatgatctgttcttttacagacaagccgttttcttcaagccggcgcttccaaaacgcgagtgctcctttcggcacggagaaataaattcttccggcctgcccttttcccacggttcccgggcggcttccctgaaaaggaaaaaatgtaatgatcgtgcccggctctccgttttggttgccgaaataaaagtgataagtggccgggtcgtcaaaattaacggtttttttaacgagccgcaaacccagcacttcagtataaaaccgaagattttcagcaggatcttttgcaaatgcggtaacatggtgcaatccttgtgtattcaatgtattcactcctaaatatcttgatttcgagatattaactattctaatttaatatgaatgaagatgcaactaaagtgtttcagttaaaaaagtaatagaattcttttttttctgaaaaatatcttgtgatcttatctgacacctgctatgataaggagcattatcaagtttcaggaggaaagtaaatggtcagaaaagcactaattttcgttctcatcttaatccctttcagccagctggccctgctgtcagtcgctaatcgggttcatccgatcattatcgggctgcccttttttcatttctggctgcttttatggatcgcagtcactccattatgttcgtttcttatttataggctgcagaagaaacaaggaggactggactgatgcccgcaaatataacagcattgatcattacagccgtcatcgttttaaccgttgtctgtatcggctttatagccggaagagacaaatcatcacgtacttctgttgaggaatggtctgtcggcggcagacggttcggggggctcctcgtctggtttttagtcggcgcggatctctatacggcttatacgtttttaggcttaacaagcacagcctacacagggggaagcgttgctttttttgcaatcccgtattctgttttggcgtattttatcgcttatttctttctgccgaaattgtggaaagtggcaaaaattcacaaattaacgacgcttgccgattatgcccgtgagcgttttgacagtaaacttttggccagtcttgtcgccattgtcggcgttcttatgctcattccttatatttgtctccagctgagcgggattcaagatacgcttcaggtggccggaacgggtgtcattaatgtcaatatggtcgtcatcatctcttttattcttgtagcgctgtatacttttttcagcggaattaaagggccgacgtttacggcgattattaaagacattctggtgtgggtgattatgctgtttatggtcgtctcactcccgctgatccattttcacggctggacgccgatgattcacactttggctgaaaaagcgccgcaaatgctgacgataccggactcggggccgaaaggaattccttggtttatcacagcttccatcgtatctgcgctggcgctctttatgtgggcgcatgcggcaaccggtgtatttacggcaaaaagcgcagatgccgtccgcaaaaacagcatgtttctgccgctttataatattgttttgattcttgttatttttctcggctttatcgcgtttcttgtccttccggaagataccaatccgcggctcgctttattgaagctgattcaaacgtcttacggcggagtcgcacagggatttgcttactccacgatcgcccttgcgtcattgattccctgctctatcatggccatcggagcatcaaacttatttgcgaataacttatatcgggatttgattcacccgaatgtgtcaccaagcaagctgacgatgatcacccgttcaatggtatttgtcgtcatcgggctcgcgcttttattcggtatgctgttcccgactgcgctcgttacccttcagcttctcggtgtttccggcatggttcagatctttccggctatcgccgtcagtctgttttggaagaatcaaacgaaagaagcgacaattatcggtcttctcgtcggtcttatcgtgacattcacggtaaatatcacccaatccgcccacggtatatatgaagggttttgggggttgaccgctaacatggctgccgttattatccttaacccgttttttgtaaaaaaagcgtcttcaaacgccgtcaaagacggtttattcaataaagcgccctctgataaactgaaccaaaaaggcgcttaacagaaaaaagccggcacatcgatgtgccggcttttttactttttgtgctgccatttgtaggtggcgacggttttagccgggatgacggcttcaaactgccgattttctgaaacgacatggaatttttgttctgaagatgtctggttgattacgactgtcacaatggattgatcaggattaaggaacgatacattcgagactgtgtttttggagccgtaattactttctatccgtttggctccgcgctcgataaattttgaaaagttgcctgtcatatgaaagatcgggatattccaatagcggtcagggtttttagcatcctgaataaacagcgtcgggtccggggtgcctatccaatgatgcgtcttaatttgactgtcgagcatcgtcacccacgcattgtagctcgacgcgccgttgcggaaatactgtgcgatccgatccgcccctgccgtcccccagacagaccgctccgttaagtgaatagattgatcaggatatctctttccgatttccgacatgacggaaaggtcaccgtcataatcgtgaaaagcgatgccgtctgccgcccggtttccttttttatcatctaaaatcggcggaatatagttccacgccccgctcgcattgtgatcataaatccaaattttcgtgtcaattatgtgttttttcaattcttttttcacggctatcgccagtttgcgctcctgagacggcggcatgtacatgctcggatagtcgatttccagcaaaggttcattttgaagggtcatcgcataaatcggaattccctgcttttcgtacgcctcaataaatttgcggaagtaaacggccagtgcgccgatatatttatctttcagctttccccgcttgaggttttcattcgttttcatccaagccggcgggctccacggtgaggcaatgattttcagttccggatttatcgccagcgcttccttgatggttgctgtaatgtgtaaatcaatatccttttggatcgagaaatgacggagcttaggatctgtttggccttcaggcatatcgtcatacgtataaaattcctgtgccgtaaaatcagatgtcccgatcgttatgcgcataacgtccatgccgataccatctttgggatcaaccagttttttcagcacttcttttctttttgcgggtgtcatttttgataaattatggattgtggattcttccagggacgatcctacgcccaacacactttgatagcggcgcgacggatcaatatacacggcggcggagtcagaagccttcttttttgtccatgtaagcggtgtttgttcgtctaaggcgtatttcacttccagcggcccgtcataccacgtacgggaagccggatctttttcagaactgaaccacacccttactttgtttttgtctgaagccttccgatcagccgcatacacttcggcttccgtgctgcttgatatgaaaaagaaaaacataagaaaaaccagggtcatgtgcagactttttttaaaaaacatgaaccaccatccctttccttatttttataagcgattctaaatgaaaagccggacagtcacctccttcccgttttaatgaatgcgctttcataattactgataaaaagccggcttcacacaacggtgaagccttccctttttacacctttaggatacatatgcgccgtttgtttcaatcacttttttataccattcaaatgagtctttcttaagccgcttcattgaaccgttgccttcattatcccgatcaacataaatcatgccgtagcgttttttcatttctccggttgtaaatgacacaatatcaataattccccatggtgtatagcccattacatccacgccatcatatgtgactgctttttccaaagcttttatatgtgacgataaatattcaattcttgaagcgtcatgaattgaaccgtcctcttctaatgtgtcaatggcgccgaatccgttttccacgataaataatggaatctggtagcggtcgtataagcggtttaatgtgtaccgtaaaccggtcgggtcaatcgcccagccccaatcactcgctgtaatataaggattttccacgccgtttggcaatcctccgtttaccacatccccggtattatcgtttatcacgtcactttttacggtagtggacatgtaatagctgaatccgaggtagtccactcggccatttttcaaaatctcttcatcaccgtcttcaaagtgtatctgatagccttctctttcaaattcttttaacgcatagcttggataatatccgcgaacctggacgtccgggaagaaaaagcgctgtctcatcgtttcttcagccagcatcacatcatcggggtgagatgagtacgggtaaatcgggacatgtgataccatcgcgccgatcctgaactcaggattgatttctcttcccttcgaaacagccaatgcgcttgccagcagttcgtgatggccggcctgatacatgacttcttttgcgttttcgttttctttaacggcgacgcccgagttcgtccataaaaagatcggattattcacatccatcttattattgatttcattaaacgtcatccaatatttcaccttatgtttatagcgttcaaaacacacttcagcgaatttcacaaaaaatccgactgtttttctgtttctgaaaccgccgtattccctcgccaaatgcagcggcatctcaaaatgtgacaaggtaattaccggttcaatcccatgtttcagcaattcatcaaacacccggtcgtaaaaagccaacccttcctcattgggctccgcttcatcacctttaggaaaaattctgctccagccgatggacgttcttaaacatttcaggcccagctcgctgaataatgcgatgtcctctttataacgatgataaaaatcgatcgcttcatgattcggataaaattcccgctcttcaattgtatctgttattttccggggcacaccatgcgcgcctgccgtcatgacgtccactacactcggccccttgccgcctttattccatcccccttcaaattggtgggcggccagagcgcctccccataaaaaatcttttggcaatgtccccatcgtttatatcctcctttatttgactgccgcttgcataccgaataaatgcactgcagcagcttcaagcaccgcttcgcaggtgtagaagaattcctgccttcattttcatattatacgtttacattataattgtaccggtataatttatcaatacataaacaattatagttaatttacgaaatggcttttaaaaacgattatgctataattctgaaagaagcgggacaataaatgaatgaggaatggatatgttaaaataccagcaaatcgcgatagatattgaaaaatacatagaagaacatcagctgcagcaaggggataaactgcctgtgctgcaaaccttaatgacccggtttaacgtgagcaaaagcacgataaccaagtccttagatttattagaaaaaaaggggattgtgtttcaagtgaggggaagcggcatttttgtcagacggaataaaagaaaagggtatatcagtctgctttctaatcagggatttaaagaatcacttgaagattttaatgtcacttccaaattattagcgctggaagtgagaaaacccacgcctgaggctgctcaaaatctgaatatgccgcctgacggcgacgtgtattatgtcaagcgaatccgatatattgacgggctgacattgtgtatcgaagagtcattttacaacaaatccattattacgtatttgaataaagagatcgtggcagaatccatatttgattatattagagacggtctcgggttaaagcgcggtttttcagatttatatctgtacgcggggatgttaaatgaggaagaagcggagtacttaggtctgtttacaggagcgcctaagctttgcgttgaaacgatttttcatttaaccaacggccagccgtttgatttctcaaaagtcacctatcactatgagcaatcacagtttttcattcaggcgaacagccacctttttgaacaggaaacgacataagacgggcttttcgcaaacaaaaaacaccccatgcgcgagcgacgcatcgggtgttttttactatttcatattcttatttaatgtttcaacggcttttttcatttgtgtatcgttgtccgcaagctgtttttgcagatccgtcatcagttttgccgttgtgtctcccgttaaaatacctgtttgtttcagcttctcttttgcttggaattgtttgactgcttgttcaaatgctttatcatacgtgccgtttacattcacgctgtaccccagcgctttcagcattttttgcgcattggtgacggtcgttccggaatccccgtatttgtatgtttttttcgcatctaaatacggcaggttcgcatattcaggaagcttaacctgatattgcggtttgatgccttttttatgaatccactctccgtccgctgtcagccattttgcgattgtcagtttaacggtagaaccgtcgctgtaatcttttgccgtctgcacggttccttttccgaacgttttctcgccgatcagcggaattccggatgattcatgcagcgcagccgacatgatttccgcggcgctcgcggtgccgtcattgacgaggacgactgtcggttttgtcactttgcgctctttcgtcgctttcatgacttctttcgtgccgtctttgtattcgacctgcatgatatttttccctttatcgataaacatgttgctcattttgatggcttcatccatcaggccgcccgggttgccccttaaatcgagaatgtatcctttcgctccttgtttttcgaggctgtcaatggctgaattcagctcttttgccgtcgattcggagaaggatgtgatttggatttcgccgatgtctccttttttcatttcagagtacaccgtttcaaccgggatggtgtcacgtttgatcgacaggttcagatcgccgacacccgctctgtgcagcacaagcttgacgtttgttccctttttgccgcggattaatgcgacggcttcgtttacattaaggcctttaacgcttttgccgttgaccttcaagatctggtcattcggtttaacccccgctttttccgcgggtgaccctttaatcggcgatacgatcaggatgctgccgtccttttcttccacttgtgcgccgatgccttcaaacgaagcggaaattgtttcttcaaacgactttccttcctgaggatccatataagaagaatacggatcatccagggaactgatcatgccttttatcgctccgtctactaatttgctgtcatctgttttttgatagtaatcacttttaatctgctcataggctttattgaatttctcaaatttgctgttcgtcaaagcagccgagccttgtccgaaaatggtcgtattgcccgtgataaacagcgtaagcgctgaggctgcgaccgcagtgatcaatataataaaaaacagtttaaattgccgcttcaagaaaacaccacctttttattcttacattattatcatagacgaacgctcattcgtcaacttcaaacgtgaggcgcccttctttcccgtttacccaaacctatgcttttctctcaacatatgctgaggaaaaaaggaggattcggcctttgagcaaatatttagaaatgctgtccttattcggagtcggaggggctcaccccggcgggctcgctttttccaaagccgttctcacaaaagcggctcctcctcctggcgaaccgattcttgacgccggctgcggaacgggacagacggccgcttatctcggccacctgctgtatcccgtcacctgtgtggataaggatccccttatgcttgaaaaagcagcaaaacgatttgccgctgaaggcttaaccattccgggctatttagcggagcttgagcggctgccgtttgctgaaaatcaattttccgccgttctttccgaatcagttctcaccttttcaaatcttgattcatcgctgtctgaaatcctgcgggtccttaaacccgggggcatgctgatcggcattgaagctgctttacaaaagcccatgccggaaaacgccatcacgcagataaaagacttctacggttttaccgtattgcaggatgaaaccgcatggaaacagagattgcttcagcaaggctttcagaaagcggatttcattcccgctgtctatgaaaacaatgcgcaggagccgactacagaaatggatttatcgcccgttattcagccggttcactacgatacgctgacggctcattacgagcttatgcagacgtaccgtgaatatatgggacactgcgcttttgtcgcttacaagtaaaacggcaattgtcctcctgttttcgtccaacctttttaccgcactctatcataagctgacatagaaagataggttggataggaggagaaaagatgcaaaactattatcatctttgccggcagcaccaaggaaaagtagcaagaattacagaacgaaacggcagagtccacgtcggaagaatcgtacgggtgactaacagcaaagtgtatatcacccctgtcggcggccgtcacagagggtacggattcggttattggggaggaggctggggaggctggggagcagcctacggtatcggccttggtttcattaccggatttgcgcttggaggtctgctcttctggtaataaagaaagcccgctttctatttttcaagcgggcttcttctcattacactttctttacttcattaaaatattcttcaagcgttaattgatggtcatggatggcttttgccgcttttttgcctacatagcgtaaatgccatggttcatactcatactttgtaacattttctttgcctttaggatagcggatgataaagccgtattcatacgcatggtctttcacccatttgccgtccgccgtgtttccgaacgcctcattcagctcatatccgttgcttttgctggaaatgtccatggcaagccccgtctggtgttcgctttgccccggatatgcgacggcttctttcgcctttttttcacctttcagactgacttcattatcgaaaataactttctgtctgtcataagaacggtatcctgaaacggcaaccaggtcataaccttcttttttcccggcgctgaatagttccgccaaagcatcggcggcaggtttgcggatatatcgtttctcgattttctcagtaaaagaaaattcgactttcgggattacgagatcattcggtttataatctcccggcagcgtatatgtcttatttacgagcgcaagtgtatttgtcgggttttgaatggtctcaagcccgttcacttctttaatatcattaaaatatttgctctctaatacaaaatcactgttttctgtcttcgttgtttttttgcttgatgtgtcatctgattgttttgtttcagctgctgtttttgtgtccttatggctgtcgccgtctgaaatgctgcagccggtgcccacgattgcggttacgctgagagcggcagcgagcgagaaccatttagtggatttcttcattttacccttacctttctttttttgaatcagggcgatgcataaagaagagggctgctttaatcagcataaccctcatctcaagtttacgatacagtatgcagcgccagtttaatcatatcatgaaaagtcgtttgacgctcttctgccgttgtttcttctcccgttaatacgtgatcgcttacagtcaggatagacagcgcttttttgccgtatttagcggcaagcgtatataaagcagtcgtttccatctctacgccgaggacgccgtatctggcaagcttttcgatttgggagtcttcattgtaaaactgatcggcggtgaatacgcttccgaccgctacgggaagattgtttttttgcgcttcctggtacgctttatgaagcagttcgaagtctgcgcaaggagcataatctacactgccgaaggcgacacggttcatctgtgaatccgttgaagacgtcatagccaaaatcacgtcacgcactttcacgtcattacggatggctccgcatgagccgactctgattaagttttgaacatcatagctttgaatcagttcattcacataaatagagatagacggaacacccatgccggtgccttgaactgatacttttttgccgttatatgtacccgtaaatccgtacattcctctgacttcattatagcattccacattttcaagatacgtttccgcaataaatttcgctcggagcggatctcccggcaaaagcactgtatccgcaatttggcctttttctgcgtttatatgtacactcatttccttttcctcctgcctattcaaactcccacccattgtacactgaataacggtaagagacaatcatcagcattgatcagggcaatcttgggcagaatatgcgggatgacaagcctaaagaaaaaggagtgaacataatgggcaaaaaacagcgcaaccgggtgaccggccagaaaaagaacaatcacgtgcccgtttcagacgtcattgcagctgatgaagcgcatggaaaagagcattccgccgctaaacggaagccttaacactgtctttcccagacaatacggaagccggctgaatcttcagccggctccgtcttacctcggctggacgagcagccggttaattttactccatcccgcagggttaagcctgtaataggtctttccttttcttccttcgtctatgagtatgacgtctccggtcgctatgaatctggcttgatagtcgtttgggaccgtatcaggcacattaaaaacagaaaatgccctttccagtgcgtcttgatgattgtcagcggccagctctgtccgatagacgaccctgtatccctttttctcgccgtagcggggtgtttgaaaaatcgtcacatcataggcacaagtcttttttttaaacacgggcagcgataacagcatcaagatccctccctcttatttcttaatagtattagcgttttttctcatttttcctgtctctatttttgtcgaaacggatgatacttttcgtcaaagagcgcaaaaagcgaaacgaggcaaagtccgagactgaatccggcaaggacatccgtcggaaaatgcgcgcccaaataaattctgctgaatccgatcagaatgacgagaactccggtaaagacggtgagggccctctttcttttcgtgaaaaacggaacatgcttgatcaaaaagtaagcgatgacgggatacatcactgccgaattcatggagtggccgctcggaaaactgtatgaggtttcatggacgagcggttcaaaagcgggtctggctctttcaatcaattcttttatttttatgtttacaatccgttcaatgagaaagagaagcggcaaaaaaacaacatccggcgtttttttgtacatatacagagctgcgcctgtcaaaagaagaagcggcaaaagcaccgcggtcgtgccgagctccgttatccataacatcaattcattcagccagacagacctgatcctgacagccgcttctatcacacgctcatcaaaagcccggacggcttctatccggatcgctgctgcgagcagaataaacaatgcgaaaagacttgctggcttgtacaacgttttccccccatgtttcattctcccgagctgattgaaaaaaccgaagctttttcacttcggttccgcagtttcagtcttcatcaagctcttcgtctatcatacatttttctaataaataatcaaaggtgatgtcggctatttcgaagatttcctcttcactcggtatgtacccgcgcatagcaagctgactgtaaaaataatcagctatttcttctgtgtcaatcacaagatctatttctttcatgcaaacaccgcctccttttttatgttttatgaaaaaaccgttcaaattatacccgaaagttctaaacgttttgtccgctcatatacttttaaaaaaacaagccccggagggagaaaagataatgacgaaaatgatggctttattggacggagatggatttgatatcgtattggaaaaagtgctgaaaggaatgtcgtttgtcatctttgccggctgtctgccctggtttttatatgtcaccgtccgtttttttgccggctagctgaaatgctcccgcaggctttccagcacaaaattcatcatatctttatattcttcgtcaccgaacaaatgataaagaatcttataatcgttataaatatcaagcagctcatctacaatcgataccgccagcacatgcagggcatcgggatcatcagcatcgccttcaaactgaagaagagcagacgcgacggtatcctcgccgatctcatgagatgcttccccaacatagtggacaaacagcagctgatgcacaaactgatccatttcatattttctcagaaccagcgtgagatcctcttcctccgtttcaagccactctccgtctttcagccgagtcagctcataaataatatcctcccagccatcctctaaatatctccatatttcagttctgtgaccgataactcggaataattcctttccgtagtcctttacatatacgacgtcgccgatcagaaattcatattcaatatctaatttttccatatcgacgatcacgccctcataatctttataaagctggatggacgattcaaaataaagcacttcattatgattgacttcataaagataatgtttatcaatttgatgaaccttcgtaatggtgccgacggttccgtacatcacgacgaccacgatgtctcccacttgaaatttcggtttatctggcttcatgctgtctcccccttgccgcggactgtcatacgctatcgtatgccggccgccataatttcgcatgggcatgaaaaccacaggaaatatctatttctgcacctgttcaaaatggcaaaaaccccaacatgcttgtgcgttttttcacttaccgtaacagaagcgtctgatggcattgcgctctcgatcgaatgagcagtaacaatgacgagacaaaaagcgcctgtttttgaatgagtttttgtttatttctccatgacacaaagataaatacccggcccgaaggcatgttgacaatatcaccgccgtgatgttcaaaatttgccgtgaaacacatcatcgaagatgtatggagatccaattccggctgcatatctgcaatggcttgtttatcatgaagaaccaaactcgtttcggctttcaatgaagccacaacttcaatccgcttcaaccttgtcacataaaattcccttttccgtccaaacgtcagtgcctcaccatagatcatttgattcctctcacttcatttaaatgtttgattatttctccgtgaaaagaggctccttacacgggaccccgccggcagcaggtctgatccggtgaactctgcagctatacattctgctgccttatgatccgtgccatcaggaagacttgtttacgcgctgatcaaaacgaaaggcattgcgggatttgatcatacggcacctcataagcgattgatttcaacagaaaaaaaccgcacaatgtgcggtttttcgtcaggcgtgatgcacctcggtctcatatttttcccaagcttcatcaaatgtcgccatcgtttctaaatagtcggcgctcagttctaaataagaactgagctcgtgataatcgcttgacgttttcggaaagccgtgatcttcgtatgcctgattcgcaaaccggctgattgcgtcctgcggtttgggatgcctgtatttcatcaaatagtgataaaaggatttcatgggtttcccctcctgatgactgtcttttgttgtactattatacaattcaagtgtgaaattacaacaaaagaagactaggagaagtcaaaataattccgtttcaagatccgttctgtccccatcagctcttgatatgtgagtgtttccggtaatttttttgcatcgactaaaaaaagctgattttcgatttccgctatgaccgcttcctcctgatacgtcatgccgcaggaggagcaggcgaatgcgggtgtttctgtaatttctatggctctcgtaccgtcaggaagctcccagtacacagccgcctgacaagctgacgccttctgattgccgcaccactcgcatggcttcacggcgactcacctccgacttccgatcctgctttttgctctttcttttgctgtgcaataaatttcttttctttcaattcatctctcttttccctgcggtctttcagcgtttcatgatcagggtttgatgtaaacgttttcctcctgtcgatcctcgatacattttccggtgtgaacgaaacctctttgtccgcgaaaatggcgctcagtccgacaggctcgcgtttggccattgttcccggaaaaacagattcaaaatagtcgtcagcttgattcgggatatagttttccggctcgggataagatgtaatcaccccttcgaagtttctgatcacaactttctccggactttgggagagcaagtagttcggctgcagggcgattttaccgcctccgcccggggcgtcgacgacaaaggtcggcacggcaaagcctgttgtgtggcctctcagtccttcaatgatttccaatccttttgacacaggcgctctgaaatggccgattccctctgacaaatcacattgataaatatagtacggacgcacgcggattttcactaaatcatgcatgagttttttcataatcggcaccgaatcgttaatgcctgctaaaataacagcctggttaccgaccggaacacctgcgttaacgagcttttcacacgccgcaaccgattcttccgtcagttcgatgctcgtattaaaatgagtgttcagccagaccggatgatattttttcaaaatctgacaaaggttatccgttatccgctgcggaaatacgacgggcgctctcgttccgatcctgataatttcaaggtggggaatgtcacgcaggtttttcaaaatatattccagaatctgatcgttaattaaaagcccgtctccgccggaaatcaggcagtcacggatttccggcgtttcccggatgtaagcgattgccgcatcgagctgttttttcggcacccccattccgatctgtccggaaaaacgccttctggtgcagtatcggcaatacatcgagcattgatttgtcaccagaaaaagaacgcggtcaggatagcggtgcgtaagaccgggaaccggtgaatcttcatcttcaaacagcggatcttcaaggtcatatttcgttttgtgcatttcttctgacagcggcacggactgcatgcggatcggacatctcgggttatcgggatccattaaagaagcataataaggcgtaatgttcaggggaatggtttttacagacatcctgacgccttcttcttcctcttcggtcaaatgaatgacttttttcaggtcatcgacggttcttacagtatgggtgagctgccacagccaatcattccacttttcttccggcacatctttccacaattcaatctccttccagtgacgcttcggctgaaaccatttgtttgtcaaacgaattcctccttatgaatggccaaacgtaaagttttgcaccatatattcatattttcgagcccttctgaaatgcggcagttgttcacaagcctgcctctgtagccgtatcccgcatgatacaaaacggcgttcatcccgtaagacgctgcacgggccaaggaaaaaagatgaatgattccccggccagcgagttcctgctccaacgctttaaacaagtgtgccgttacggagttccccctgtaatctgacagaaccgcgcaatcggtcatttctgcgtgccccaaaaccggattgatatctgcgcttgccgccccaatgagacgatcctgatcgaatgcggcataatagatggtgttttctttcattgtttttttaatataaaggggattaaaaacaggagtcggataggtaagaaaaacatgtttatataagtgcgttaaacggtccgcatcatcttcgtccgcttttctgaacatcagcgtgctttctgtctgagtcattccccgccgcggtgtctcatataaacggtcaacagccgaatcttctgatacatatgaatctgaccgtctccgttcctctgataaatagcgcaccatcacaacagccttatgcccgttgtaatacccgtctatggcaccctcaataataaaaagatgcttgacaaattccggctcatcgccgcgcttggcaaagaaaatcaccttttgggctccctcttcctttgcttctgccaaaacggccggtataagcgcctcgggctgtccgtcataacgaatgaccctgatccgctcgttgaaacggtctgcatcaatctcggccgctccgctttcagccctcagttcctttatcagcgctgtcacccccatctgccaccccgcaccattccatgataaaaagagaaatgattttgacggcatcgattaacgcccggacttcaatgtattcattcgcctgatgcgccgccttgacttctcccggaccgaagacgatgaccggcgtctgtcccgcgtgctgcaaaagccctccgtccgttccccacggggacgcttcacgaaccggttttgcccctttcattttctcaaaagaagattccagagcggaaatcagcggatgctcatccgggagatcattcggaagccactgagccccaaaccattctatttccgcggggtggtgtttaaaccattcatcccggtactccaaatctttcagccagcttgccagctcttcttttactgcttcgggcgtttcatccggcgctattccgcacctgccttctatcaccacacggtcagctaccgatgatggccacgttcccccttggacggtgccgatattaatgggaaccggaatcggaacgtcccgataaagcgggtctttgatacgggcgttacggacgtgttcaagctctttaagggctgtgatgacatgcaggcttttttcaatggcgctcaccccttcatagcgggtgccgccgtgtgcggacaatcctcttaccgtaatgcggaaccacatggacccttgctgcttaacaaacagctttaaattagtcggttcgggaataagcgccccgtcagccttgtagcccttcataacagccgccagtgttcccgcgccgccgcactcttcatctacgacactttgaaacagaacatctccttttaacgtaatcccgcaggcttcaagcgcttctaacgcaaacaagagggctgtattgccgcctttcatatccgttgaaccgcgtccgtaaactttgccgtccttttcaacagctgtaaacggttcatacgtccatgcggcgggatttccttccgggacaacatcaatatgtccgttcagtatcagtgatcttccgcccccggcccctttctttacggctgtgatattcgggctttcatggaagtcttcgcgttccgatacaaaataaggatgctctttcaattgtttgacactcggctcccagacatcaatatccatgtcaaactgtctcagtttttctaaaacgactgcctgtgcgttaaattcatggccgaacgtgcttttttccccgatcagccgtttcagcaggcttaccgcttttgctgtgttttcttccgcccactcagtgactttcttttctaattgatccatggacagacccccttttaagaaaacattctcccaatctgatttcggcatccgttgtttgaatgacatcgtctatggtcgtgccattcagcagttcctcaagaacaaaagccccatcatctatgctgatgacggctttctctgtaatgatgagatctgcacagcctgctgctgtaagcggcaatgaacagctttcgaccagcttcggccggcctttctgatcggtgtggctcatgacgacaaccacttttttcgcgccttgggcaagctccatcgccccgcccattccgggcacctttttccccggcacgagccaattggcgagatcacctgtcctgctgacttggagcgcgcctaaaatggtaatatctatcagcccttttctgatcatggcaaaagacagagctgaatcaaaataggaagcacccttaactgtactgacaggaaatccggccgcattgcataaaagctcatcctcctctccgcgctccggactaccgccgatcccgaggacgccgttttccgcctgcagcattacctccatgccggccggcagaaagttcggcactaaagaaggaatgccgatccccaggttgacaatcatacctgaggtaatttcactggcggcccgcctcgcgatactctctctttccgctattcccaagcccatctccacttcactccttcactttgcacgataccctccacgaaaacgcccggcgttacaatatgctcgctgtcaagttcgccggcaggcacaatttctgccgcctcagcaaatgttctttcggccgcagcagccatcagagggttcatgttgcgcgccgttttgtcaaacgtcagatttccgaattcatcagcaatatgtgccgacacaaaagcgaaatcagccgtcagcgctttttcaactaaataggactttccgtcaatcgttacggtttctttgttttcacaaacggttgcgttatcaatgccgatatcagttaaaataccgcctagccccgctccgcctgcgcgaatccgttcagcaagcgtcccttgcggcgaaaattccacctcaagcgctccgtcagtcatttgtctgcccgcgacaggatttgagccgatatgggaagcgatcagcctttttacccgcttatgaacgataagcggaccgatacctatttccggaaatccggcatcattgcagatgacggtcaattctttaacgccgctttccaaaatcgcttcgattaatgacggaggtgaacccactcccccaaaaccgccgaacatgatgacagattcgtccttgacatcggcaattgcttcatgaatatcgatttttttatgaaaaatagacatatcagctcaatccttcttcatcattttttcagcttcttctgcggactgggaaaatagatctgacagctcatccagctccgcatatgaaatcgtgaacggcggggcgatgatgacggcgtctccttctccgctgtcaataccgggctttgctgggtaaataagcaggccccgattttttgccgctttaatgattttttcggtgaaggcctgttttttcgaaaaaacgtccttcgtcgttttatccttaacgaattcaaccccgatcaggaggcctttaccgcggacatccccgatcaccccgctgcggtctttgatttcttctaatttccgcttcagcattacgcctttttcctctgactgccgaagcagctcgtgtttcttgacatagcgaagcacttcaagcgccgcccttgcacagtatgggttggcactgtacgtatgtccgctcataatgaccccggagccccgcttgatcgtttcaatgatgtcatcagacgcaacagctgccgcaatcggagcgtaaccggcgcccaacccttttccgagcaccgcgatatcaggggcaatcccccaatgctcagaagcaagcatccgccctgttctcccgagccccgtcatgacttcatccgcaataaacaaaataccgtgcctgcggcagacaacctcaagcgcttcataataacctgccggcggagtgatggccgccccggctgctccgacaatcggctctgcgacaaatcccgcgataaatgaggaaccgatccgctgaacagccgtttccagttcagccgccgcagctttcacaaattcctctccctgcagctctgaacgatacatattaggcgctgaaacggccggaaaccgttcaagcagctgggtgaagcggtatctccgttcatagaaccctgataatgaaagcgctcccaaagtaatgccgtggtaacttccccatcttgatagaaagacggatttttggtattgccctttttcctgccaatattgaacggccattttcatcgctgtttcgactgcctctgagccgctgtttacaaaaaatgaccaattcagcccgcccggcagatgatcggccagaaataaagccagttcttccgccggagtactggtgaattgcgagcgatacacaaacgaaacggagtcaagctgttcttttaaagcttgtataatatcctccgtgccgtggccgatattgcaagtgaccgcccccgatgctccgtcaagatacttgttcccctcctgatcatacacatatgatcccttaccatgactgactgacggataatttgcgtcaagctccggtttgattaaatagctccccatatctttccacctcgaaaacccatttgcttcattgtatgaacagatgaataaccgcattcttatccttcagaaagttttttgcagaaaatacctttctgtaaaacaggctgccggaaatgtcccgacagcctgaagagcgttctggaaattctattcctattgttgattttattctttcttcggttctgctatttatctgctcatcccatcatttttgatctgaatcagtataagcagaaggcggaaaattcccgtcttctttactgtatgggaatcaatatttcacacaaatgatgattcaccttttgtaaagtatacctttcgataataggctgttctctgattgataaattatttttttcgatctcagaaaaaacagtgttccaaaatccgctgactgcctcttttgtatgatcaagcaagaaaacggcgtacttccctccggaaaatgtaccgatccgggctggttcaggcacatggtcttgattgataacaagacaaacatcatagcggcatttctctttaggagtacgattcggatgatcttgcggaattcctaaaatgacagaataatcaagcagaccattcaattgcgcccagtttttaaatgactccatcagttctttgttttgctttccgccatactctccgacgtttcggaaataagcaattctggattctggtaattcttcaatcgtcatgttcacattttctcccccttctccagaaaggtaatatgtattaaaatgtttttcaagctgatttttcagcatggaaataacaaaaagcctgcagaaaatgatgttctctgcaggctgattttcattataggattttttcagtctaacaaataaaagccgcaccgacgatgattaataaaataaacaataccacgatcagcacaaaagtgctggttccgcctccgcagccgccgtgcccgtaaccatagccaaaactgccgcaaccgtagccatatccgtatccgtacatacgcaaatcatcctttcttcttacgatatacggcattgtatgcgggccaactcccaattggtttatgcgaatgcccaactatgtaagaaaataatgaaaaattgtatgcacgcgccgaaatcttttgaagccgagtttttcataaaagcggtttacaccgtccatcccggacgtcacaaggtatacggtttccatgccgttcagctttgccgccgccatcagctcattcatcaatatcgatccgtagccttttcgttggaattgatccagaattgcgacttcttctatttttgcggttttatctgctttgttgatgaaaagctctccgcagccgatcggaatcgtttgcgaggcgtcgctgtagcacacgacaagcataaccgttccctccttatacaaaggatatttccgctcaagcttttgttcggccgccgcctcgccaatgtaaagggcatcatagatgttcataatagacgacccatcggcgaggctcttttccgtcccccaagcagtgagcgggtgtccggcctgcaggtccccattttccagtttccttgcaaaaaacagctcatcttccactacgcagccctgctttaccaaagtttgtttcagaagaagcggaaatgcgtgctccggagacgctttcacatgaatataattggcttgaagcatgcccggaacggacgaaagaaacggcagcagtttgtctaacggaaatgtacggtgcagctgaacaaagttatgcgaaaaaatctgcggcaaaaaagggtccgtatatacactgaaatgctcgaacctctgaatgccggaagtaagctctatatactgcttctcggttttatcaaattgatcggtcataaaagctctccttttccttgcacatccgactgcatctctcaaccttttgttatattgagatttcttataatttcatcgtacaccggatagaacggcattccaattggtaattgtttaatttgctgaaaggaaatgggtatcgccttctgattcgcaaaaaatcgtttcgctacgtcatgactgatcggatggagaacccctctcaaataaacataaaatttccgttcaatgcgaaacagcatcctcccgggcaaatgttgaacacagtccgatgtccaccggctgatcggcggaccgtccggaagcgattgtatttcggcccgttctaaagccgggatgccatgccgtttaaatcggtaaaagcgaaatgcgctatgatcaaccagccttttctccccgtcttctataaaataaacatgaaactgatccctgacgagctgaaaattcggaatactggcggagtcctcttcctcatattgaaataaaaacggatccggaatgacgacggtccggccttcgtataacgtatgccagcgctcgtttacaggcttccttttatttcggtcaagctgatatactttctgatccgtcccctttacaaaggatccgtcgatcaggacagacggaagcgattgatacgtgttctgaaatgagtggggtgttttataggtcgtatccaacacttcttttatcggcagaaatgatgtaaatgtgttgagcctgctccaaaaaacagagtctccgtgattccaatgcataacatcttcgtcccaaaagctgccgaacttctctttcacacgctcaagcaatgatctccggtgcatcactgaacagtgatcaacgagaaaagcggcctgatcaagcacctcttcagcaaaacgatagaagtggaattgttctgttccgcgcccgtttacatgtatcaccttctggctggaatagacggcatcaaactcgctgcattgattaagcgcttccgccatgcggctgagcctattcggatgaaatacggtgtcgtctgtcaaataagtgatgtattcgccttcggcccgtgaaagcgcatcattaatcaaaacggcataccgggtcgacttcagccgttcggccggattgataaaactgttgtcataatatatgcgatgatcttttatatacgtactgatggcggccgaggtttcttcatttgaatgatcatccatcacaaacagctcccaattgctgtaggtctgatgcaaaacactttcaatcgcctgttttacaagatccggtttgttgtaactcgttaagataattgagatcttcttttccatcccatcaccccttctgtaaaacgtaaaaaacggctccgaaagagacagagcctgatatcgttattaaaaagccccccagctgacgatgcttgaaatcgcgacgtttgatctcgtattattgagcggattttgaaaaacggccaaatctgacagcacttctttgacaattacgttctgcagtgtgctgccgttaatcagattgacgcgcgacacaggaaccccaagctcttttgccattacaagctgacgccgcaaatctgaatgatctccggacggctgatgagataacaaaagaagaagaagcagtacgagctgaaattcctcctcaaaacccccgtgttttacagtttctcctgaatccaaaatattcctctccttcattttttaatctatacaacgtatgtcatactcttacaatccgcataggcaaacaaagcctgattcgaaaattcagctgtttgattaattattgaaaaaaatgcaagcaaaacggcattcgacttataccaatcttttcaatcaggaatatgaataaacgtgaggttgaaattgtaaaggaggtgtatgtccgcatgagcgaggatcgtttggagcttaaaaagaagttattaaaaactcttttagcccctgtatttgacaacagcgctttatctggcggcacagatggaggagataatgtggaaaacaaagtaaaagatttattggaatcggcaattgatgcaaaagtggatgaagcagcggcgaaagacagtctcagcgcacaatctgtattgggaagcggtatttcattagcggcgagatggatttttgcaagaattcagcccggcactgtcatcagcattgtgatggattcaggagacatgatcggcccggttcaatttgttgcctttgacgaaattcacggaatcgtttttgttacgcaggaaaattccgttacaccggcaggctctgctacaacattgcttgacgtcgacaaagttgaaagtgtcacgttcacttcgtaacagcatatgaacgttttatatatccgttcaggatataaaggcatatacacgtattttgaccgctggatcgaggaaggctttttacagtcttccgtccgctttttttctgtttctgagtttgaggaagataccatccgcagtatacgggcattcaaaccagacatcagtctgatgatgacgggagaccgtattccgtctgaatggcttcaatggctgaagacagaacagattcccgtatatctatggatgacggaggatcctttttatttcgatgtgagtatgacaatcgcgccgcttgcggatgccgttttaacgatagaacaaaacgcgcttgatgcttaccggcaaatgggcttacagcacgtatattatgtcccgatccccgttaatcagcggctttttaaaaaacaacctgctgaagcctctcttcacacaaatctgcttctgatcggatacccgtatccgaaccgcgttgaactggtgaaagcagcggcgaagcttccgtatacgcttcgtattatcgggaagggatggcgcagacatctgcctaaaaaaatcgccagacagcaaaatgtgctcgtaatggatgaatggattgaacccgaacttgccgcattatattacaacagcgcagaggtggtcttaaaccctcaccgttcttatcggtttgcgctcaatcagaacggacgcggcatcgaaaataccagtttaaatacgagaagcttagacattgcggcttgtcaggcctttcagctgacagacctttctcccgcgcccccgttttcaacatttgtttcttacagcgggtttgcggattttgcggataagatccatttttatatgacaaacccgggtgaacgtaaacaaatcgcggcgcttaattatcaagagacagtaccggcgtacacgtatgaccggctgccggctgtgcttacggctatccgttccaagactttctcatgaaacgctcttcacatcaaaaagcagcttggataagctgcttttttcatgtttattttccgcttctgtcagtcagttttctcgggtcaacctgtttattgacctgcggatgaaagccgattttatcagcgattctttcccatggcaccattttaaaattttgattggccttttggccgtgatctatattctctccgtcctgtgcgacaaaaaggccgaacggatactcaggccccagcccgaaacccagaacgtcaattccgtctgtatcgcttgtgccgtctgtttcaggcccgtctgttatctgaaagtccgcaacatatttgttctgtccctgtctttcataaatcgcgtagctgctgttaccctggcttgaggcaagcagataacctttcccgtcagcagcgtagtaaatcgtcagtccttcaatatcaggggttaaatgcctgccatcggcacgatcgataaccgttccgttactgccgccgtccggctcagcgctgaacttccagatggcctcatcttcttctgcgatataaagactgccgtattcatcgtctgctgccatcccttctgtctgagaattcattttaaacgcccttacctttttgccggatatgtatccatttttatccgcatttaattcgtattgttcaaattcgccttctttccctgtcaccatcgcgtaatattttcctgttttttgactgtggtacaagctgaaaccgtatacttcatcaattgctgatgcaatcgggcggtttggatccgtaatgctttgtaatgtgccgtttttcccgtcaatggcgtaaatctcaatggtattctttccttcagaccgattggatgccgccgcaatatcgactttttttccgttcaacggaaaatcataacggatatcaacattgttcagcttcccggtatgataggaatgaagcatctttccctctaggctgtacacgactaagcctgattttttattggttgtgatcaatttgctgttctgaggattcttggggtccagccaaatcgcaggatcatcagctgcatcaccggctgtatcaaccggctccgtttccgccgccgcattcacggtaaaatgataaggatcagacagcttatgtttggcctgggaagaaaccgcaccgcatgtgagcatcaatccggctgccgcggttaacaaaagtgtttttgaatgattcattttccatcctccttttatgaacgtgcactttaattgtaaaatacatacaggaagttcagtgttaagtttttgtgaagattgtccgaatgtgaggatttatgaagagaaaaaattgacgtgagcaaatatttaaaatgaatatttagtacaatgttttatttgtaatttctattctattaatcgggtaacgcgatatgaaagcgcatcagattaatgtttttctctaatttttgatttattggtttctttcattaactcgctgaaattgttcaacatatgatgcatggtagagaaacgagagttggaggataagccatgcctaaacagcaagcagtagagctacaaccgttttttcacgataaaactgttctcgtcacaggcggaacaggatcaatcggaagccaaatagtaaaacgccttttgctcttaacccctaaagaagtcattgtgttcagcaaagatgacagtaaacaatatgtgatgaagcaaaaatacgcggatgaacaaagactgtcgtttgtgctcggcgatgttcgtgactacagaagagtcaaccaagtgatgaaaggtgttgatattgtctttcacacagctgcgctgaagcaggttccgacatgtgaggataatccctttgaagccattcaaaccaaccttatcggcggacaaaatgtcgcagaagcggctttgctgcaagaagtgacgcatgtgattaatatcagtactgataaagccgtttattaagatacttaccacaaacaaatcaaaaaaagaagcttactctgcactcctttccaaagcagcctccaataaatgctgagcaaattgtttataaaattcatctaagtcattactcgcttcatcctgatctatatagcggatactgtaattatctttatggacaacctttattgtttttttctttaattcctcataacgttggtaaggttccaaaactacacccccgctttcacaggagtattatatgtatgtaatggttcgtctcttgactgttctttctttatcaaagcctcgcaagcttgttcaaatgtatgatccagcgttcagtaccgatctcttcgcatatgaatatgggaatgctggctttattcaaggtgcccagtaattcaaaatgtgttcttgacatatgccttctctgcacctgagtcaacaattgtcaaataaatcctggggcaggaataagccaccgcgaatgaagaatgacgtgaggtttgaagacattatttcggttcaatatgccgcttcagttttgcagcggttttctgggaatcaaagaataaatactaaatactttcaaactttgagatatttgtttttggcggtgaagattcattgaatcttttataccaaatacgaattttttgtcctttgctcaagtcatctttattgttaagttgactaagtcccagtaaaactatatccgatctatactttttaataatctctttttcactaagattttcatagtctttaacattagctttttcattatgtatgaaaattgcttgattctctccttttaaaatgacatagccgaccatggtttgctcagcctccataaaatgtttgctttgggttttgacaccctaatgttatacttaacaaaattaacagcattgtacataatctatacaagttcaaaccgcccttcttgcatatttgtaacaagagtaaaacactgttttaggaaatgacagactaaaacgactcatttttaaggattttaacaacttccccgtagtcttatggaacacggcgaggtctttaccatcatagaaccgcacaattgcatcatgaaatatttaattggctgatcaaccacaacaccttctttaagcgatctaatgtggaatatgtgtaaggaggcggtttatttgaaaaacgatcagaaaataacacttgactcttcttttgcgttatccactcttattgtcttacttattgcattgtacccgtcctattcttcttggtttgtcacaatattctttttaggatttgcactaatatacacatttgaaaaaaagagcaaatcttcaaaactaattgctattatctcttatccattatttattgttgcgtttgtttacagcataataaacagcatgtaataatcccccgcctaagacagggttattttttatcacattgcagcaacttttgggccgcctttgtctgtgatgataaagctgtcactcccgattttttcttttgatccttatcttcataaatcgttacaaggtgttttgtcataagagccgtccctgccatcttacattcctgcttatcctaaaagtaaacaattttatattcacctagaatgatcattattagctaatccagctaaatcagatgaccagccccctgtaggcaaattaaaagcaaatcctaatgtttgaacgacagcagcagttgagtatttgtcaaagttgatcgtagacgttgctttcagtatcattccaagtctgagttatctcttttcgccttaactcctgccccaaaatcataaagcaaaccactccagtaaaattccaacaatttcaatcttgccaatggtgtttcttaaacctaattccccctctgagtgttttatgatattacactcctgaaaatatttgtttttgttaaacctacagttttattgaatcttctccacggcataaaatgggcatccccaatgagactttcggttcttttttaagaaaattgtgtctcgtataataacaaaagtatgtttttaaaattcttgttccttcttttataactaaaattttttaggtaatatattgatttcattacaaatatccattatatttgtaaatatattaaactaatggttatttaaggatggtgaagaaatgaagaaaaaacttatttcatttatcatggtgttcacgttggctgtgctggctatatcagttgtttctcctggctatgcaagtgcagcagaaagtaaaaaagcacctgtagttcaaaatagcgtacaggctcctttagcttcaaatcctgaagtacatacacagggcattcctttcgctaaacaaatattagtaaaagcacttagggttggtggccccgctttaggaaaccttattaaaaagatcccatataaatgggcacaaaaagctggtgatgcttgttctaagtggggacacaaagcggcggacgttatagatgaacttacaaatttcggagaaacagctgttactgtggccttagtgaaagccggaattccattagctgatgcacagttaattgcgaaggttgttgtgttctttttggtataactatacattaaaaacaagagagtgaggcttacaaccttcactcttttgttttaattaggtaaggagagattaccatgaatctgcttgttatgacgttatcaatttatcttttatctctcatcgtcttttttatttttatgtacagaggagaaaagaaagaagctgcagaaaaaaacacaaatgaaaaatttttattatctacagtaataggagctttggttttatcactcattcctactgcaatcataatggtgataatcttatttgcaacaggatcagcaaatgtgcttgtaaaattctttgaattagaaatagaatttaaacagattgttataacaagtgtgtgtatggttgtttattcttttacttttgataatatttttgtggctgttggaaggcatctcattggggataacttcttcaagtttatatttgcctcgttgtttaggtttttatttatttatatagtgggtatcttatgttccattgggaacagcgacaattttaaattatcattaggattaactttattttttcttttgttagaatgtattttccctaaaaagtctgaccgtgcccagaatttaaaatcttaaggacgggcatttggtgagaacattaattcatataaaaaaggaataatgttcaaaaagataaagcaggcttaatgtctgctttatttaattaaaatccctcttcatacagtgctttctctaagcaattcggctcctaaagctacactgaaccttccagctttatactcgtttacaacaataaagtaacaagcaagttgagaaatctcgaatcttgatatgctcaatggtactgttgtttttgcttcctgactttgagactgtaatgggacgctttatgtctaaaaaatctgcctataatatcgtttactgtgtagtcgatataatttatattaattggcattcaattgctaataacccgctcactgaacggaaaagcatgcttttagacattaaccttgaccataacaatgtatttgttattgaaggtctgcagggaaacggattagcttactttaatctgccaatgaaaagcatcttgaaggaatcgtcgtattaataaagctaactctccatatgggattaataaacattcttatagctggctgaaagtgattatagatttaagactacatggtaaactccgcataccttcctttgaatcttggagagtataatctctctattacataactccttaatgcttagcaaaacagactgaaaattcagtacataatacaataagttatccaaatcgtttagctgtaattcaccaaaatgctcttcatattttgtgacagattcattccagtttgaataaacccattgacctcctgaaattaaatgttattatttactttaacttacaaataaaggagtgtttaatttgaaaaagttgtttagttttattgtttgcaccatggtggccattctttctctgagcattgccactgccgcatctgctgagaccgacaattctaggttttcaactaagcttactaactctgtcgaaagtgaatttaaagcttttggtcttaaccctcctaattcaaatagcgttgtaaatcttacgaaaaacaaattgacattcgctggacaagcaactggcaatacgttatattcaaacagttattttcaaggcaaatcttcgataagctattcaattacaaataatattggaactaaactaactgtgaaagtttggaatgattccgactggatttttgctactgaaacactaactgtaaatgctaacggtacagctacaggaacaataaaaaatctagatgccaatgcgctttactatctatctttctctgctccgagcgacttttctggctatgttcaataatacgtaatctagcagctccattcgtggggcttttttgtattcgttaaaaactatcgtaagagagaattggattaattgtagaaattttgatatattagtaatacaatcgaatattcaaggctgctcctacacaaaaaacaagccagtgataaaatccttcttcttattattttttatcttagtgttaaattttttcacaggggctgattttatgtttctaataaacaattcttttgactttatgagcaacgtaacaacactagttgattttgttggcattgtaggtgcgataggctctgccttgagtatttgaataaaaactatcttttatctagacttgtccagctctctccaacatttcaaagagattgtgcctgcctcaattagtttggcattgtagtcttcaacctctttctttgcgctggccaatttatcaaaagctactcgccaacaccattatgaattttgataaaagatttaatcctcaagccatcaaaacaaacatctaaaattagtctattgcctgaagtgccatcaattttgctaaacgcagcttctttattgtaccagcataaagcacctcttcaatggattcattggtaaagtactcagtttccttggttgctacataggttttcatttcttcctcttactacgtttaaaatcacgatttcatcttcggtcctagtgatcttaagtcctttctctatatatacgcagagtgtatttgagttcgcacagtatttagtgaattgtatttgatatcaataacttcaatattaattgactctgttcttataaatatatttaatagcctatcaatttcaacccattcaccattgcaatattcatcttggaatagcgttattttaatcattgtctaacccttcctttaatgaactgctttcgtctaactttcggaaaacatattaatctgctaacaaatagctcatcgactttatcattgtattcaccatattcaccagagtcccattcaacacctacagaacctcgatttgtcgtccacaatataattcccatttctccattctcaaagaccttacttgctcccctttttgacaatcgagtatatttcaacctctttcttaaaataatcacattttaagttaactttaaactgcattatgttgagaatttcacctttaattggtaagctgacatctaagtcatacttatacaaagcaggtgatatattgaacaaaataatcggaatgaccggattaattatctccttacttgtgcaagggttttcagcaagtgattcattgactcataagatcgccatggcttgtctatttttgttcttattggtttataattttaaccatactaaggagttctctaaaaagtctctggcgattataggcgcttcctttattgtgctgatgcttgggatttatcaattgctctcttttactggtgattactttgaaagtctcggtttaaattttggaattatcctcttacttgagattgctttagttattggattagtgactgctgcgctgagtttaattaagcatattgcagaccgcttaaggaaaacacctgatggtaaagagcgttgactctttgcctttttttagctaaccatttctttttatgccgtctttcttgtacaaaatcaaacgcaatatcgacttttgccggctctgttctgtcaatgatgaattgatttcagaatgattcttaattcctcatcattcattggactccgccttaatggactcttcttcatttttcaccagaattttttcaaaagatccagtcgcatttctttctttgataagagctctacatttctaatagcaagattgaatattatttgttaatacactcggccccaacttttgcgtcttagaatttgaaaggcgtacttgcacttgaacatttgtcacttcagctgatatggaatcaatccttccagcccaattaggactctctccctcgggagtcggatatagtttaaatcgccaactgatctcccctgttttggaggcaaatccttcataaccgtcgtagcttccataagaagatggctgaggaaggtggacagcaagaatactcatattcgttctcgcagcacttggcgggtataactgcactttatagattagtgccgcacccttcgcatttttcaatttttgattcaccggttcgagtactgcactacaaggcattggacttgctttcatttgagttggagagacaataacagcagccaataaaggtataaccaaaataaatcgtttcatctaaattccctcacattttttgttaattttccttactcccgccttgaatattcatcacttttgaatggttagcttcattaaaaaaaaggtgaaaaaggcagtactgaagctactagcgctgccggtaaagatggaaaatcagcatatgaattagccgttcaacaaggcttctccggaacattagatgagtggcttgcctcactgaaagcaacaggaaattgatcatatccccttctcgaacgagggggcttctatcgcattccacaccaaattgagaaattaagaaaaaacactcttcctaatatattacattatgataaaatattacataatcagtcgaaatactaggagggtgatttttttggagcaattgatctcttcttcaaaggttggcttaaaaatcaataaatggtacaaatacataagattattcagtgttgcagatgcagaaattctaaagggtgaagttgaacaagaaatagagcatatggaagaagatcaagatttattgttgtactattcgctcatgtgttttcgacatcaattaatgcttgattatcttgaaccaaaaaccatgaatgaagaacgacctaaaatttcagacttatcagaagagatcgaaagtaaacaaagcgatctaaaaggaattcttgaatattattttaacttttttcatgggatgtatgaatttgaacagtacgaatatcttaaagcaataagtttttacaaccgagctgaaaagaagatatctattgtccccgatgaaatagagcgagctgaatttcactacaaagttgctgaagtgtactatcacatgaagcaaacccacatgtctatgcatcatattgttcaagcaatagaaacctacaaagcacacgagacatactcaataagagtaatccaatgttcattcgtcatcggtctgaattatttagacatggagtatccagaaaaagcaataccgcatttcatgaatgcattaaaacaagcacaagaaattgatatgccgcggttaataggttcttctttgtacaatctcggtttatgctcatttacaacaggacatatggagaaggcattggagtattttaaagaaggcgtctcaatttatcaaagtaattctcttcacaattctagccgactgcttgacatacttctaatgttggcaaaaacgcactttaaattattcaacacggtcgatggaaaacaggtttgtgaacaaggtcttatgctttcaaaggagttgaacgatgacgtattaggaaaaatgtttgattttcttatgggtttattcgttgagaatgacaaagaacgactttttaaaatcttagattacttagaatcaaaagctatgctttcggatgtggaagacctagcgactgatgcagcaatgtattataatgtaaatgaagaccataaagtagctacagccttttatgagaaagtgctttatgcccgaaaacaaattcagagaggggattgtctttatgaaatttaaatttgcatcggcttttatctttttagttatcttacttgggcttgttggacattatcttcttgacggccacaaagtttttaaagaagcccgaagaggccacacagccagtatccatatcgcgcttgatcaccataatgacttctcagtggaacgtagagggcaaaccgcataaatgttttggcactcccgcatagggggtgtttttttatgatctgtgttcacctgtaaagctctatgcaatgctgtccttcatagtaaaacaggtaagccttattcatagctgcaaccaaaaaaagcacaaataaatagtattgctcctctaaacttgtgtggcaatcatacaaaaacacaaaaggaacagacctaaacagtaatggagaagcacttgtcacatctggatattgaccgctcatcaaaaactgtctgctcctaatcatttactttgcagatttattctgcaagtgtgtttttttatataaaagatatggagcgttatatgaaaaagtcttatgttttatatgggatttcaggagttctaattggtgcaatagttatattgttgatcaatgcattctttataaataaaggtgaacactctgtaagtacttctaaaataaatccaaccgaggataaaatcttttttatctattcaaatccactcatcaagaaaagcgtactcatatccacatcacaaggagaaaaattcaataaacgatactttaaggtaccggatataccatatatccagaaaaaaaccccctcttcagacgatatcgtcttgttagctgaacatgaaccatattattacacattaaaaaacaacactattaaagaacataaattatccaatccatttgctttttggtatcaaggagaagatatttctgtaaaagcctataatgtcgacaccaatggaaatgaactgaaagtaaatgataaaaagttcaataaaaaatatagcctgactttgcctaccctcgtaaccatgggaggaagcgataataggtatatttacgtcattcaaggaatgtctatgtacgtcattgatagaaacacagaagggattattaaaacgattggattagcttcctatggagatgtatttgatcactctgaaaaatatgttgtagctagctcagaacatgaactaactgtaatcgaaaaaggatcatggaaatcaaaattcataaaatatcctgatgatctcgaacaagcggacgctgtgtattacgacaaaaaaagcggtaaattttacgttacatatattaataaatccgtatacgcctgcttacttgagtacgataaagatttttcttttgaaaaattcgatttaaaatttccgtatatgaatgcaaagtttaaagatcaaaaactttatgtaatttcacaagaggaaaacaaaaaagggattggtggctatatggggatttttgatatccgtactaaaaagaaacttaatgaatttgatttgcctgaagaagaaacaaaagtgcaggactttatggttttagattaaacataaagaataagttgcaaagcaaaagccccttcctgaataaggggctttaattttaaattaaatagatgttttatacgcgttaatggcttgatttctcaaaagcatattatctttcgtaaccattccaagattgtatgcttgtttgatgatatctaacacttgattatcagtttcagttacagctcgtcccccagttattctggacttccagtaatcaaactggtgatttaactctgaactgcttttaaggtttttattatcaactactttgccattctccagcgcttctttgaattcattaaaaccaattgaacattgcgtattcgaactaattcctgcaccttctgtcgctaaactgcaaaacgctaaaaatttcggatctttcgtgatattgtaagagttatttagaccttccataacattcatcctctctcgaattttacaacgttgctataaatgattttcatgtttttcccaagaccttcaacttgaatctcatttgaaggaagttcgttcattggaatttcaatgtatttgtcccatcctatcacaactttgttttgtccaagtatagggtcatatttgtatatgttcgcttcacctttgtataacaaatttctcccatcctttgctttaatgacggtcgaatttgtatagcccataaagcgaactttaatatgcagcttgtcacctttcaaaacatttgttgcatttggcttgctgcttgtaacaggctcccatacaaagtcgtttccatccgatgtgacggaaagaatctgaagactgtaaagcggtgttgcttcaattgcttttgctttcgatgtgctaatggaaaacatcgttgtaacagcaagaagtgtaattgttactaaactaagtacttttttcaatcccttaacctccttggtattatttcacatgttatttatcggtaattccagccgattatttaactcaaattcaaaaaagaacctgattctaacatggttcttttcgcataggtaactgaatgggtttttaacgacatataaatgattcctgtacattaagtatgctcacttaagggaatcttggagtcttggagtcttgctcaccccctatagaaagggggtgatgcttatgtcaacatttcaggcattaatgtgaatgcttgcatttgggtcgtttataatcgccctgttgacgtatataaataaaaaatagacctcccttgagcctgataacctgaagggttaggtctatcatgaataacataacatctgagcaagccctttgatgggttgcgaccaacaccatgctctttttattttatgcatttcttgttaaagaaatacactataaccagtctgtattttacagattgattataacagattaaatgaaaccattggaatggtttgcaaaacttttgtttattggataaaatcattattgtatttggagccgataagcatctttaatgtatcaatgcgctttattactttccaaatacttctcatgttgtctttctaaaaccttaatatcctttttaatgatctcaactttatattcttctttaacttccttagataagttatcgtttagatagcgtcgtaattcttcttcattttttgttttatccataccaattgatatgactgggtctgtttctccaattccaaggctaaataagccaaattcatcccatgcactttctaatacttcctcagtggatttttgatttttaaaagaatgtgtaactgcgccatacatgaacacagaaaaacaaacaatgatcaagaccccaattaatttctttttcattgtctcctcctttcatttcaagaataccataaaatacaatacatggaaaaataattcctcagccaacagtatcctagttcattacgggttggttttgagaggataaatgctaatccgtatcttaataacgaattagattagcttaagttaccgtctatcatcgtttgtgaaagtaacctcccacacattcaccataattctcgggaattttattttaatactttaaggagttttacatattcatcttcaccaagaaataatacggttgtaaagcccttcttttcatatagatgtcttgcgtttaagttatctgtatctacaccgaatgttatttcctcaaatccaagttgtttagcataatcaatcaaataatcaacaataataccgcctatcccgcaatttcaatatccttctttaacaatcatacgagacagataaatgcgtttatccggaatggtataatctgggtcattgttttgaaaaactaacgatccttctcctataaactcgtcattcactgagtaaataaaagtaattctgtttccgcttactaattcgtcataaaacaccttagccattttctttttcttttccatgtcccaaatattattacacttatggtattcttcgggttttaatttctttacttggtacgaatccataacctctctccctttttataattagtttctatcgaaaataaaaaagctctctttctgagagcttaactttgcaatacttttcctaacaataaaagctaattgtccttaccaaagagcaattttgcaaagtcattgtctaaaacctcaatttccacatcactgtcattattatcagtttcaattggttcatctactaaacttagaataaactcttcaaaagagttggcaataaggaaaaagtctttatcggggtgacttaattcatgatcccaaaacaatatcttttcattatcgatatccatgcatatttcattcccacctgccgagcttgctataggaataatgttcctgggaaagcgatcagaataagtattgattgcttcttggagactgttatgatcgttagctaaaccatagaagctctctattaattgtgtatcatcttcctgacccatccaaggatctttctctataggtttgtagcaaacgtcatactcaacctcatctgttgtttttttactttctaaataacagcctccatatcccttcaaaaaatccttatagtcggaaggcaattgattacctatatttctttcaatttctttgagctgctcgtttgtattaatgctaggatctgtgccagcattaatcgtaaactctttcaacttttgtttgatcttagtgaagctcattttaatactccttcatatgctatggaaaaacagatatagaccttctttttagttttaatcgtcccagtcctcatcatcgatccagtcgtctttcgattcttcaagctcttctattaaaaactcttggaatgtcctagcaacttgtttaccatatccctcttggttatcccaaagaatgactgggcattctccatctatcatcttgttagtgtcaagacaataagaaaattcatctacatattcgatcactacaagaccatcggaaaggttataatattttttatattcattggtctgctcgacaacttcagcgccgtgagagtcatatccgagaatcattgttccgtatgctcccctgaaccatactcagttaaaaaccatttatagctgtctggaagagttacattgagctcctcttctatttctctaatctgatcttcagtgactcccccgtgagaattgaattttctttattttcatcaaagaaagtttttattttcgaataatccattaaactttcacctcttattcttgattctcaaattgctgagctctccatctccaataccttcttctgaaacttttatattgtttatcaagcacaggatcatttctaaaactctgtccattcccttttaatccatgcaaaacatcactgtacttattatgccagctttcaggtatctccagcatagtaccaggctcttcttgaattaagtgatgtaaatttatttgcgtgccatctttagcaaacggagcattaccatttttcatcagttgaagattcgtaaagcctttacgatttttttgattaaggtcaatatctttcattgtgtatactctacggcttacatctctaggctctcctttaacttttaccttgccgtctatttcataggcctcatacttctctttatttaaccaagggacatttactttctgaccagtaaatggctttctgctttcatccaatttctttgcactggacaaaagtccatttttaaggttttggctgttaaccacattgtatggtacgttatcagccagagcaagatcatacttagtgttataaggaagcaaatctgaaatcttaatgtccttaattttctgacctgcctgtcctgccttgtttatgaccttccccgccgcatcagctttgttaacggctcctgcgccttttgttccgacgacagccacagccactgaaccgaccgcatatgtcacccatcttgatctggagtaagcatccccgttcaccatatctttttgatacgattcctcaatagctgttgaaatggcattatacgtgttaattggatgggcaactgcccctatgataccttcaacaacttcatcaggcttgctgatcagctgccacaaaccggttaccgtgtctttcccgacatcataaaggccgacgccggctccttttaaaatatcccaggtcacttctccggcttcttccatctgttttgcttgttcaagctgcatcacatattgttgttgggaaggttcaaggttctcgtaaccgatcttcttggcaatctccaagtattcatcaggatcagttactccatcagagagctttttcttcagatccttgatttctcgctctttcgcttcttcttttttaatcgtcaaataagcatctgaatgtcttgcaatctcgccttttttcttatgtatgacactttctctgtacgccttgacgttatagtgaagtggtgttgcgtttttccctttacccgtggcattttggagctgttgaaagtctgcttggatgaaattctcgttcgcttcggtttctgcgtattccttcgttagatcatgatcgagctttccgagcttgtgtacggtattgtcccgtttcttatctgctgaatccagcttttgatcgacatcctctgtcgagaaaacatcaagatgaacaatatcgcttatctcattaagaatatccctcatttcattccgctgctcctgcatgatagcttttgatttattcttcgcattaatcagttcatgttctaaaaatgactcttccacaaacgaatcggtcaatccggcatcagatacttttccagaaatactgttaagaaaagcaatcttcatatcgatcagatcaagccagctgtctgtaacacctgcgtgatcttgaaagaatgccttgatgttatcagcacctttgcccgaaaactcattgtcatctaaatcagccattccctgaaacgcttttctgagattgataaattgttctctaatctgatcgtattcttttgcccgtttctccgctactgaaattaacgaggatgcttcaaatactttcatttacgtctcctttctgcttctttctgtctaaattttaccatagctttattatttgattaacagaaaaagacagtccgttccgactgtcatacacagttttatctcgtcctgtaataattttcagctgtatagtatttccagtcccaaaaagcatccccgttcgacataatatatcggtctaaaaatatttcaaagtttaaatttaatggattatattctgaaccactttcaaatataaatagataattaggatcaccttgattcactctatccttgtcgatcattaaatgacattcttccaacaggtagccacaggtattccattgataccttcaaacaaaagctcgtattttagttcttcttctatttcttcaaggctaaatagatgaagacctcctccaatattctcgccctctgaaagaatttcgaaaattttcgcaccattatgctgagaaataaacttcaggtaatcatcaggaagagtgaatttatgattcgactgaaagttttggatttcactaagagacgctttgtttggagaaaaagtcacaaggctctctacaatatatccctcagaacaaaacaatttaatagcccctttttcatctaaaagacttttcaaaccattgatagtcttatggacaaagttagtcaataaaaacacccccatactcctcagaataattactgaggatacgaatttgttaatcagtaacaattttattcataattgaagcagcacttgtggtgaacaaaatgtaagtgttatttgctgttttaattactatcctatccgtagagccagtttgaagtcctctgaggcttcttttttatttggtacattcaatctaaacaaaaaaccacagagcgtgtgagggactctgtggcctatagtggctgattaaacccctatgatacatcaattaggattttatcaaaacttttcttttaaagataacatcatctctgtctcaaataatgcctgcagcagctcatctatattaatttctttctgcttgtaattattcttttcataagtacgaataatttcttcatattctgatcgattatctcctttaatggagctaattccaagctcttcaccgtatcggttaatgaatagttgtttattcatttctttcgctttatcattttcataattacaaaatgcacctgacaactggacgagaaaagtttcatcttcagaatttaggttattctcgtattcaatgtcagacagaatattgtacgaatacttctgtttttacagtaaatacaataaagaggaggtgctgtttttttggagttaaaaaacatcgttcattcttacaacattacaaatattttgggttatctcagacgctctcgtcaggatatggagcgggaaaaaagaacaggcgaagatacgctaacagaacaaaatgaactcatgaataaaatactgaagtcgattgaaatcccctatgaattaaaaatggaaatcggatctggagaaagcattgagggtcgccctgtttttaaagaatgtcttaaagacctcgaggaaggcaagtaccaggcaattgctgttaaagaaataacaagactcagccgcgggagctacagtgatgcgggacaaattgttaaccttcttcaaagtaagcgattgattatcattacaccatataaagtttatgaccctcgaaatcctgcagacatgcgtcagattcgttttgaattgtttatggccagagaagaatttgaaatgaccagagagcgtatgacaggcgctaaatacacatatgcggcacaagggaaatggatttcaggactagcgccttatggataccggttaaacaaaaaaacatccaaactagtcccagtcgaagaaaaagcaaaagtcgttcaattcatctttaacatctttttaaatgggttgaatggaaaagaagttagttatacagcgattgcttctcacttaacaaaattacaaataccgactccatcaggaaaaaagcgctggaatcaatacacaattaaagcaattctgcaaaacgaagcgtatatcggaactgttaaatataaggttagggaaaaaacaaaagacggtaaacgaacaattagacctgaaaaggaacaaattatagtatcggatgcacacgtccctataatagatcaagaacaatttcaacaatcacaagagaaaattgcaaacaaagttcccctgctgcctaataaaaacgcattggaattaagtgaattggcaggcgtatgcacttgttctaagtgcggtgaaccattatctaaatacgaaactaggcgaacgcgagaaaacaaaaacggcacggaaagtgtgtatcacgttaaatcactcacttgcaaaaagaataaatgcacttatgtgagatataacgatgttgaaaatgccattctggattacctctcttctttaagcaacttagataataagactttaacaaaacatatcatttatatgatttctaaatacgaagacgtaaatagtaatgtgaaaacaaagaagcaaatgtctgaacatctttcacaaaaagaacaagagttaaaaaacaaagagaattttatcttcgagaaatatgaaagcggcatttacactgatgaactttttttgaaaagaaaagctgttttagatgaagaatttaaagaactccagattgccaagcatgaactcaatggaactcaagaagcgcaatcagaaatagacagtaatacagtcagaaacaacataaataagataattgatcaatatcacattgaaacaagcacagaaaaaaagaactcgctattaagaatggtcttcaaagaagttatcgttacgatgacacaaaaaagaaaagggccaattccggctcagtttgaaatcacccctatcctgaagtttaattttacgctttcgatctcaccgccactgatagttcctcaaaatgcagtaaatgtcttaaaaaaccgataaagccgtttccccggtaaacacaatgggagctacgaagctgttgtccgagaagctgtttcatcaggcgaatcatcatgttcaaaaccgcggtacggtgttttgttcggtccgcttcggcaatgtgctcggttcacgcggttccgttattcctattttatttgagcagttgatggcaggcggtccgctcaccattacggataaaaacatgacgaggttttttatgtcgatcgatgacgccgcaacgctcaccctgcaatctgcggcgattacaaagggcggagaaacgtttatttttaaaatggagtccctgaggcttgaagaactgcttcacgggtttgaagaatatgcgttccggcacggactgccgcagccagccgctgttgaagtgggaaaacgccccggtgagaagcttcatgaagaactgacctctcctcatgagacggaatctttatatgaatggggcaatctttacgcgatattgccggatcccgccaaacatccggaatttcggaaggtcaatctccccagatatcaatcggatcaggcgccgctcatcacaaaagaaacaatcgtaaagattattgaacgattacatgaagaaaaaaaaacatagaaaaaaggcctgtctgataggcaggcctcattgctgagctctatttttcaaataaatgcaggcaggcttcatagccctcttccttcagcttgtctttcggaataaaccggagtgccgcagagttaatgcaataacggagaccgcttggccccgggccgtcattaaatacgtggcctaagtgggagtccgctgttttgcttctcacttccgtccggatcatcccgtggcttgtgtccagtttttcgtcaacctcttcttcctcaatcggttttgtaaaactgggccagccgcaatgagaatcgaatttatccagagatgtaaacaagggctttcctgatacgatatcaacatacagcccctcttctttgtgatcccagaattcattttgaaacggcggctccgttccgttgttttgcgtgacttcatattgcatgcggtttaatgatttgattttttcttctttattaaaagccatcttatctgtccctccaatgctcatccagaaagccttgacgtccggaacctacacggtagcgcccgtagtgatcaggatttttcttataaaagtgctgatgatagccttccgcttcataaaaaggctcagcctttaaaatgtctgtgacgatcggctttttaaatatgccgctttctgcaagctgtttttttgaggcttcagcgatttgtttttgttcatcattatggtaatatatcgccgcccgatatgaacttccgcggtctgcaaactggccgcctgcatcagtcgggtcgatctgctgccaaaacagctcgacaagcttttcatacggataaatgtcaggttgaaatgtgatttgaacggcttctctgtgtccggtcgtttcactgcacacttcttcgtaagtcggattctcagtatgacctcctgtatagccggacaccaccttttcaatcccgggctgttcgtcaaacggcttcaccatgcaccaaaaacagccgcctgcaaatgtggcgatttcttttttttctgacatacgggtgccctcctttgttcatacgtggtattattatattatagcatgtataaacagaataaaaataattctgctctcaggagaagctgaacgaatgccacgctgactacatattggaggttcatgatttgaaagtaaggacacaaatgatgtatgatatggaagctttgcttcgaaaagtgtttaaacaaatcagaaatgaagttaatgaaattctagataaagagctgtccaggaacgaattcaccattttgcggattctcagtgaacaagggcctaaaaaagtaacggaatttgcccccattcttgaggtctccgcaagccacattaccgcagtgaccgatgctttagtagaaaaggaatggatcacccgcatccgttctaaagaggacaggcgaattatcagaatccatattacggaagccggggagaaaattgtcgatcatttcaaccagaaaaaaacagaatacttttttaaacggtttgactgctactctgatgaagagcttgcaacgttaatcaaactgttcagcaagctagacaaaaaacgctgacacaaaaaaacacaaatccctgaaaggatctgtgttttttttatgaaaacttattgtttcggatgataataggaaaattcaatttcatccgtgtcgagattgattttatccgcttttacatacatgccgttgtctaaaggcatttctgacagacggatctcgatgcttttatccccggaatgaacgtgcacaaatgacgggagttcataaaagctgtccatataattcagcacaaagctgattggcaggcttaattcacctaatgaaaacttcgtcactttcaaaaccacatctccgttctcctgtacggacggttcaaatgtgacgaccgcgttaatggaggttgagaatgctttgattttacctgccacgtgcacatcgttattgatgtccactttgtagtcaagctgattcgatgccttctcttttaagtacgaattcacaaacctggcaagtgattctttggagcttgtgatatgaaagccgtactcactttttgtctgatcttgtattttcgcctgttctcccggcataaccaataatgtcacaattaccgcggcggcaatcacattgagtgcgagaagaacaaaaaacagcgatttccattttttcatcatttcaccctattctgctggtaacccttgtttttctatgatgccgtataatcggtcggcgatgagtgcatacccttttgcgttcggatgaaaatcatcatcctttgaaatccgtctgctgccgcttttttgactgaacaagtcttcaacattcaccgcagcggcgtgaggatctttttccagctcttttgcggcgatcttgttccaatccgtcacaaccccattaatttcttttaattcaggcagcgtaaacgtgaatggattatacatgctgacatacaccagctctgcgttttcattatatttgcggatttttgaaatgatcgtcttgaaccgtttttcaaaaggtttctcttccttttggaacggctgaaccgtcagctgcatcatattctggcggagcaccttcattaagtcattgccgccgatggtaaaaaagatatagtcggcgctccttaatgatttctgcacttttttattatcaagctttttcagcaggtctgacgttttgtcgccctgcaccgcataatttttaatatctaccgttttcacatgtccctttttcttaagagactccgctgtcttgccgacgtatcctgaaccgtcaggatctcctactccttcagtcaatgaatcaccgaccgcagctatgacaatatgatctttcgttttcggttcttcagcgtcagaaccggtgcgctggacagaacaagctgataaaagcaaagccagtccggcgatcaatgagaacattcgcagcttcaatctggttgctccttccccgtctactagtggaaagtgtaacatgttttttcagttttgaaaatgtctaatctgccagtttacttgagctcctcagccgctttgacatctgagaggatatcatcatacggaaccttctgcacgccgtcataatctttaagcaccttgccgtcaggtccgactaaataaaaagaagtttgatgtatgacctgatcctctccctccggctttttgacgattgctttaaagctgttcagcgcaaaatcttcaatgtccttttggctgtaaccggtcagaaaatcccagttgcgaagcgaaagcggatatttggaagcaaaggctttcagctgtttcggcgtatcattttcaggatctacactgaatgacacaatccgcacgtccaggttctcagccttcagttttttttgcagttcggtcatgtgggccgtcatcggcggacagactgtattacagtttgtaaacataaaatcggcaatccagacatgccccttcaggcttttcagtgacactgttttcccgtcttggttctgatatgaaaacggctcaatctgatagttcagcgggtcttttatcgttttccccccgcaggcgcacaagagcagcaaacaaaagacggcagcgaagcttttcatttttttcatttccattccccccatagataaaacgcttacagcgttcatcataaaaaaattcccgcaccctcccttatcaaaaggaaggcgctaaggaatgtgcaccgttatgcgttatgttttaaaatctcttggctgaaaacggcctcataatctttccacttcatacggcgcttgacatattgtcggaatgaatacactgttctcacactttgtgaagcaaaaacttctctcaaataaagctcaaggtgctgatgaatttgaaaaaaatattgttcaccttccgtgataaccggtatttctgtcacttttacctgaatcccgtcctgtcgtttgaactctaggcttttgagtaacaagatatcaatccttctttttcgattgttttctttttattatatacaatctgagaaagcgtgtctgtcattttgcgcggccgttctaaaaaaagtcagattaacaggtggaacagatcctgatctttattcacctctacgtaatgaaatcctttttgattcatccgggcaatgagcgcgccgtaatcttcccgatgcttaagctcaatgccgaccaatgcggggccgctgcttttgttattttttttcgtgtattcaaaccgggtgatgtcatcatcaggaccgagcacctcatcaaggtattcgcgaagcgctcccgccctttgcgggaaattaacgataaaataatgctgcagcccctcgtaaatcatggagcgctccttcatctcctgcattctgccgatgtcattattccctccgctgaccatgcagatgacgtttttccctttaatctcttctttgtacagatcaagtgctgacacggacaatgcacccgccggttcagccacgatggcgcattgattatataattcaagaatcgtgctgcacacttttccttccgggacaagcaaaacgtcatcgacgacggtttcgagcgtttgaaaggtttcagcgccgattttttttacggccgccccatcgacaaatttatcaattttctcaagttcaaccacttgtccggcttttttcgattcaaaataggaggctgcgcccttcggctctaccgctatgatttttgtatccggcgagatgtttttcatgtacgtgccgatcccggacaggagtcctcctccccctacgcttgcaaaaagaaaatgcggttcgacgtcaatgtcatttaaaatttcgatggcagccgttccctgtccggccatgacatcgggatcgtcaaacggatgaataaacgtgcggttttctttttcacagcattccgcagaactcttatacgcatcatcgaaagtgtcacccgtcaatatgatttcaacaaattcttttccgaacagttccacttgggatactttttgtctcggtgtggttgacggcataaaaatcttgccgtgaatgccgaggtgtttgcatgaaaacgcaaccccctgcgcatggtttcccgcacttgcgcatacaattccgttttcagtctgctcttttgagagctgcctcattttattataagcccctctgagcttaaatgatctgactacctgcaggtcttctcttttcaaatagatattgcagccatacctctcagaaagtctgtcattcctctgcaaaggcgtatgtatcacaacgtcctttacgttttggtgcgcttttaaaatgtcttttacctggatgagagagtcttctttaagcaacggtttcatttacagagtcctttcttatttaaatccctatttaatatgccattataacatgaatattcaaacaataagataattattttaattttgtaaataaaaataaatgaaccgatacaagagaaaaagatattttcgatcgcataaacgtgttatacttaaaccaattagaaccaaaaggagccaatttatgagtgtaattgaacaaactgatcctttttatcagctagccggcgaacatcacaccttttcagaagcgaaacgattggcctcgcaatttgccttatctgatttgccggtcttcataacgggtgaagtcggaaccggaaaaaaacaaatggccagagcgatccatcataaatcccgcagaaacagcgaactatttattaccgttcactgcagtcaaagcgaagagcggctcgaatatgaactgttcggggctgaaggcgcattaaacagggcccgccgcggaacattattcttatatgaaatcggagacatgccgctctcggtacaggcccgccttctttccgagctggacgccgggctttccgcccgcatcattgcaagcagcacggcgaatcttggcgataccggcgcggaaaacacgttcagcatagatttattttacaggcttcacgtgttaggccttccgctccctgctttatctgaacgaaaaagcgatataccgcttcttctgcagcatatgctgacagcctcggggcagcatgttcatatcgatccgtccgtttatccgctgtttgagcggcacacctttaacggcaacatcagagaacttgaaaatgcggcgcactatatggccgcggcagcatccggcagcacgatttatcccgagcatgtcccgccgtatatcaaaaacagccagaaagcgaaaaccgctaagaaaaaagaaaaacggctgacattgatggagaaagaagagtttttgtttattttggaagcaattaaagacttaaatacaaaaggcgaacccgccagcagacggagcatatccgaattaagcgaaaacagcacaatgacattaacgccccagcaagtcagaaacaggcttgattacttagaaaagatgaactatgtgacaaaaggccgaggacgcgcaggaacaaaaatcacattagaagggttgacctttttgcagtcactgcaaaaacaaatcctttaaaaaggaggacatttgattgttcacaataaaagaagaaatcgcaaatgccgtcacacacggaatcggtgtattgctgtcgattccggcgcttatttttctcattatctttgcggtgaaatacggctcgccgacagacatcgtcagcttttccatattcggcgcttcaatgctcctgctgtatctcagctcgactcttttgcacagcatccagcataaaaaaacgaaagacattcttgaaattgtggatcattccgcgatatacgtattaatagccggaacatatacgccatttttattaggaccccttaaagggacgctcggtctgacccttttaattattgtttggtcgcttgccatcggaggcatcgtgtttaaaatcttttttgtgaagcggtttatcattttttcaacgcttgtctatttaatgatgggctggctgatcatcatcgccattaaaccgctgtacgcttcgctgtcaggtcccggtttcggccttcttcttttcggcggcttattgtattccgccggcacaatattttatatttggagaaaagttccgtatcatcacgccatttggcacagttttgttttaggcggcagcgcctcgatgtttttctgtattttgttttattgcgtcaaagttccctttatctgaaataaaaaagcacagcctctcgtatagagactgtgctttttttatgcacggagccgtttctgaccggccggataataagcgggctttatatgtaattcaatatcagccggtttcagccgtttcaataacctgccccgcagcagccggtctgttcccgaagtgctgacgggcacaatcgggagatcgaaacgaagggccagttcctccggattgattttgccgtcttcggacagaatcagactttgccctttttgcagccggacttccgcctcctgaagcactgcatcccggctgtctccgccacaaatgacacccatcagacgcagccaatttccgagaaacggcatccggaaagctttctcgccagcgataaaaccagccggctcttcaagatgtcccgcaagcagcagaagatcagccgggcgcaatctgggatgcacatacaatacggggccgtccggtatcggctgatcatgatgaatgccgattgccgatcccgacacgtcaatgcagcctctcataaaggctttcggccgctcatacaccagcctcatctgtttttgaaaagagagccgcgggtcaagctctttttgattgatatattcctgaatatttttcatgaacataaatacaacgtacatcacaaggcagccgtaacgaatcaattcttgtccccctgcttaattctttttctcgtatacaaggtactcataatcgtaagggtttttttcatcttttactccctgtttgcgggaggtcaattcccattcagcttcattaaattccggaaaaaaacggtctccttcaaagacatggtgaatttttgtcatgtaaagtctgtccgcatagggaaagagcgcactgtacagctgggcaccgccgattacaaagcattcttcatccgccgggatcagcttgagcacttcctcagccgagtcggcggtaatacagcccgggaatgaagattcgtcccgtgaggttacaacgatgttccgccggttcggaagcgggcgtccgattgattcaaacgttttgcgccccattacaatggtgtgacccgtcgtcacttttttgaaatatgcgagatcatcgggaaggtgccaaggcagatcgttatcttttccgatcagccggttctcatccatcgcaaaaataaacgaaatcatacgctgacagctccttttatgtgcggatgcgggtcataatcctcaatgataaagtcttcaaacgtaaaatcaaaaatagaatcaacatttcgcgcaaaccgcagtttcggcagcggacggacatcccttgtcagctgcaaattcacctgctccacatggttttggtaaatgtggacgtctccgaatgtatgaacaaactcacccggttcaagtcccgtcacatgcgcgatcatcattgttaaaagcgcataagacgcaatattaaacggcacgccgagaaagacatccgctgagcgctgataaagctgacacgacagttttccgtccgcgacataaaactgaaacaggcagtggcagggcggaagcgccatatgatcaatttcgccgacattccaggcgctgacgattaaacgtctggaattcgggtttgtcttgatgtcatgaatcagccgggagatttgatcaatggtctcgccgtccgctccgcgccacgaacgccattgagagccgtaaaccggtccgagttctccgttttcatccgcccattcgttccagatgcggactccgttttcctgaaggtagcggacgttcgtatctccttttaaaaaccaaagcagctcatgcgcgatggacttaaaatggagctttttcgtcgtaagcatcgggaaaccttcctgaaggttaaaccgcatttggtagccgaacgtgctgatcgtacccgttcccgtacggtctccttttttttctccgttttctaacacatgacggcacaaatctttatattgtttcatttttttcatccttttaaagtagtcttttagtagtgtaacacaataaaaaatcatttctgcaaaatttctcagaaatgatttttttatttcttctcgctattacacgctcatccagtcaggcggcgtattgcggtcccagtaaatgctgccgagctcatgatgtgattgaaatccgtcttcagcggtatggtaatgaaaattaaaccagtagccgtcttgcggaggatgatcccggcggacgtggaaccttaaaagatcttcacctgtcagcctgttatacacatgaaaaattttttcagtttttccggccgacggtttactggaaataaccacatcctgatacgcttcatcatcttgaaacttggctaaatgtcctgtgatgacatcttcgattttcggcagaatttcacttctgtaatcatcttcaatgaccggagagattttgctgccgaattttaaaaatgattgattttcagcatcaccgagaagctgctgctgatacgattgaaacagtaattcaggctcccgccctgccttcgcttctcccgtcagggcgtgttcatcataaaaagcggtgtaatcattctgctcaagactgctcgactgtcctgaaggcttgtctgtcatcaaagcagccggaggagacacgagtccgaacgttacaatggtaaacagaaccacaagggtctttttcatccacaatttcatgatagattgttcccctctgttttattgtcctcttttcctttattttagcatagattaaagcgcggcgtcatgtccggcaccgtattatcatgcaatatgggaaattggtaactgtgaccgagtggataaaccgcttacaataagaaggagaaaaaggaggggatgagatgattaacgctttatttgcgactgtatcacttctcacgctgctttattttgtcgttatggaaatcactgattaacgaaaaagaagcccatgatatcatgagcttacatggatgacaccgaagtggaaaagcgccgtctttcttttcagcaccttgaagccgtatcgttcaaaccgcgggcttttccaatggtctttaagcactacgcattttttcgccgcccggacggcttgcgtgatgcactcttcgttaaaaccctcttctgccagcgcgcggagcggtgcaatgccgtctgacgtttcaacaggttcgtgaaacatcgggtcaaaataaatgacatctaccgatgaatcaggaagctcccgcaaataatcggcgcagtcggcatgtttaacctgaatgcgtttcatggcggtttggagctgctccattccggtttcccacgtttgaagtcctgtttctacaagcaatgagacaagcttgtttttctccaggccgatgacttgtccgctttttccgactgccaggcttgccaaaatcgcatcggatgccaggccgagcgtacaatctaaaaaggaatccccctcgcgtaatccggctgcttttaacaacggctcggcttcccctctcaaaaaccgctttgcgcggaacatcgctgtattcgggtgaaaaaagaacttctccccttgcttcgtgtaaagttcgaaccgttcctttccgatgactaaaagatcgctagcggctcgttccagcattttttcaatgggctgtttattgcggctgcagtaagtgtcacccagcctgacactgagtgactgcgctgtgtgtatcgtgtattcgcttggtctgtaactcgttgtgatcatctttttctccaaaaagaaaatgcccggaattcgggcatttcagcagtgcgcatcgaaggcatccgtcagatttttcataatttcctccatgtcatgcccttcgatttcgtggcggggaataaaatgaacgacctctttcccttttaacagcgccattgatggcgaggaaggttcctgccccgtaaaatattcacgcatttttgcagttgcgtctttatcttgaccggcaaatacggtaaccgtatgatcaggcgctttttcatgctgtaaaacagcctgagtcgcagccggacgggcgagaccggctgcacagccgcacacggagttgacaacgaccaatgtcgtgccctctgcctgttccataaagctttctacttcttcagcagtcgttaattcctgaaaacccgcacccgtcagctcacggcgcatcggcacgaccagctggcgcatatattcttcataagccattgacataaaaaagccccctctaaaaatccttatatgaagtcaaggatactatagagggggccggaattcaattgttcaggcctctgttttatattttcatgattccgcctgtattggcgcttgttacgagtttggaataccgggccagatatcctgtttttactttcggctcgaagcctttccattcggccttgcgtttttcccattcttcttcaggcacttgtacgtccaaaatccgtttttctatgtcaacgatgacatggtcgccgttttctacgaatgcgagcgggccgccttcagccgcttcaggtgatacgtgcccgattgaaagaccccgggacgctcctgaaaaacggccgtctgtaataagcgccactttcgggccaagccccattccgacaatctgagacgtcggagcaagcatctccggcatgcccggtccgccctttggcccttcataacggataatgacaacatctccttcttttactttgcggtttataatgccttcaagcgcggcatcctgggaatcaaagacgacagcgggccttcatgtcttgtaatcccgtcctgtacgccgcctgttttgataatggcgccgtccggagccagattcccaaacaggacggccaaaccgcctttttcggtaaacggattgtcaagcggatgaatcacgtcataatcctttacttcatgacccgcaattgtttctccgagtgtgcggcctgttacagtcagcgcgtcaagatgaagcgccccttcttttttcgccaattcattaagggccgccgagactcctcccgcttcgtgcagatcttcaatgaagacgtccgaggccggcgccaatttcgataagtgaggcacccgttcagccacttcgttaatgcgttctaaagagtactcaaccccagcttcattggcaagcgcaagcgtatgtagcactgtgttggttgagccgccgagagccatgtctaacgcaaaggcgttgtcaatcgctttttcggtgacaatatcgcgcggcttaatgtcttttttgatggtctccatcaattgggccgctgattttctcacaaactctcttctctccggtgaagttgccagaattgttccgtttcccggaagcgccagaccgagcgcttcagacagacagttcatggagtttgccgtaaacatgcctgaacaagatccgcacgtcgggcagccgaactgttccagctcctgcaggtcgctttcaccgattttcccggcttgatatgcgccgacgccttcaaatactgaagaaagcgaaattttgcggccgtcgcttgtgcggccggctgccatcggccccccgctgacaaaaatggtcggaatattaatccgcatagccgccatcagcattcccggcgtaattttgtcgcagttcggaatgcagaccattccgtcaaaccagtgcgccgagacgaccgtttcaactgaatcggcaatgatttcacggctcggcagtgaatatctcatgccgatatgccccatcgcgattccgtcatctactccgatcgtgttaaattcaaaaggcacaccgcccgcttccctgattgcttcttttacgatttttccaaattcctgcaggtgaacatgcccgggaacgatatcgatgtatgaattacagaccgcgataaacggcttgccgaagtcttcttcttttacgccggcagcgcgaagaaggctgcggtgcggcgctctgtcaattccctgtgtgatcatgttgctgcgtaattctgccatggtgatcccctactgtttttagactgtgcactatttttaaaattttcagtttattctagggcgcgttctgcaaattacctgtttacagcgtctttgccctgtctcgcttttctattctttctgtatttcgataaaaaccctccaacaattaatattgtacttactatatagagttttgaatcatttttcaacaatattctaaataatttttataaaaagtgaattcaaataaaaaaggtgcatggcgcacctttttgttataactgttctttttttctgctttcagtcatctgtttccagactgaacctttcgcctcttctccgtgctcaatccgttcaatcgccattttgacttgcaggctgacttcgaattccggatcgtcttccgccgcttttaatgcttccagtgcgctttcatcgccgacttcatataaaaacatggccgcgcgccagcgcacgagcttgcttgagtcactgagcgatttcgtcatagccgggatggcgctcgcatcgccgagatccgacagacagtcacccgccgtccttctgaccgtcaccgttttgtcttcaagcgctttgtataacagcggaagcacagacggcttttcgatcattcccaaataaacgacggcttgtcttctgatcgaagtcttcggatcatgcagcgccttttctaatactggtaaatcgtcttcatccggatccatttgctcaagatgggcatagcgctgtttccagtcttcatcatcgagcatttccaaagtcactttataagctttccgctgcactgccggtttggcctcacccttttgctgtacggctgcttctgtcaggcgtttgagccgctcatcactgtaggcggcctgaagctcttctgtgacatcgtgtccgatttcggtaaaatccccgaagcgcacgccttgttctttccaagcccgctcaaatacaacatttgaagcttcggaacgcagctttaagatggcttcttggaaacgttccggaaggccgaagcgctcttcacgttcgccgtccgtcaatttgacctgcatcgggattccgctgaacatttgtacgaaaaccttcacttcaccgaacgattcctgttcagaacggctctcagactgctccgtatgttccattccgaaagcggaacggacctgaggcagaatgtccttccagtcaaaacgggcgtttctctccacagccaggaaatcggcaacgtgataaacaccctttactccttcaatgtttaaaatatcacgtacgacggccggagcatcatctgcctgatcaggcttgtaattgttgcttttccccgccggaagctcttcagtcaaaatcactttcatcgtgttcggactcggcgtcggttctattgatttaatcttcatattggtcctcctatgcgcaatctgacacttattctaacatagtcggcacaagcgttctattgcgccgcttagcttttgccgatgccggcctctttttggatacgggcggcgaactgcaaaagaaattgatgccgctcctctgctaaacccgcccccgcttttgtattcattaagcctttaagcttgattaatttatcctctatatgggccagcacacttgtttgagttccgtacatcgggtgacccttcgcgccggcaaacataaaagccctgccgatgcccgctgcgccgatcgcatcaagcatgtctgcatcctgaacaactttcccctccaaggaaagcggccgctttatcagcagttccctgtgtctgaatgacattctcgtgatgatatccgcgatctcctcaatggagccagccgcaatgttgaaagcagccagccgttctgtcacttcgcctgccgtcagcctttcgcttttttcgagcttggcgtcaatcagatcatgaaccagcgcggccgtctcagtgataaataagtcggcgccttcttcttttgccatataaacagaaagtgttgcgacccgggaaatatgaagccagtcatggcccgtacgttcattgataagcttttctctgacccaattcctgacgctttccagctgctctttttcgttcaccgtatcacctcttatcgggccaaaagcctctgcaccgtatcttcaagctcttttgggttgacgttcggtgaaaaacgcccgttgacttcaccgtttcggtccacgataaacttagtgaaattccatttgaccgcttttgtgccgagcatccccttcgcctgttccgtcagatatttgaagagaggatgagcgtctgccccattgacatcaactttcgcaaacatcgggaatgtgactccgtagtttttcacacagaactcttgaatttccgcttcatttccaggttcttggttcatgaattggttgcagggaaatcccaatatttcaagaccttcctcccgatatgtatcatagagctcctgaagctgcttgagctgggatgtgaacccgcatttgcttgctgtattcacaatgatgatcaccttgcctctgtaagccgatagcgtcatgtcttcgcctgttatggtccgtacgtttatatcgtaaattgtcatctgcggccctcctttttacattcttcatttattttacctgttttacactgcaaaacaaacggtaaccgctttttccttccacttaacggaaaacgtttttttcgaggaaccaaacggctctttacccgtcataataaaagagccgctccgaatttatacccatttgccgcttttatccctgtcattatgcgttaaatacggtttattacgccgggatggattgaaaaatggcttaaaaatttctataatgaagaaaattaacggggaataacggaggtggcatgttgcctattaatataccaaatcacctgcccgctaagcaggtgcttgaaagtgaacacatctttgtaatggatgaaagccgggcttttcatcaggatatccggccgcagaagatcgtgattttaaatctgatgccgaaaaaaatccaaacggaaacccagctcctcaggatgcttgggaattcacctttacaagttcactttacgtttttaattccgagcacacatactccaaaaaatacggcaaggcagcatctggatgaattttatacggatttttccagcatccgccacaaacggtttgacggaatgattattaccggggctccgattgagcacctgccgtttgaggatgtttcttactgggaagaattgaaggaaatcatggaatggagcaaaacgaacgtcacttcaacactccatatctgctggggcgctcaagccggtttatactatcattacggcattgagaaagtggagctgccgaaaaaaatcttcggtgtgtttgagcataccgttcttaaaaaacatgagagattggtaagaggatttgacgagctatactatgtgccacactcacggcatacagatattaatacggagcagctgcaatcggcttcggatctgaatgtgctcagcgtttcagaggaagcgggggtctgtttaatcgtttcaaaagacgaaaaacagattttcttaacgggtcatccggaatatgataccgatacgctgcttcaggagtatgagagagacatagagagaaatctttcaaacgtagaagctcctaagcactattttgcgcccggcgggaaagaacctgttaaccgctggaaagctcatgcaacgttattgtttatgaattggctgaattattacgtatatcaggaaactccgtatgaatgggattaatttttgttttaagtgatacggtgacaaaaatatgataaaatactcttgattcagtatgcgtataacaaaactttaaaataatggaacatatcaattaaatttagtttaaatatgttggcgcgcttattataaaatgatgcacttgtgttatgtttatctatagacaataactccttacgatgcatgaagcttgcttgttgttgattacattgaggtgaatttacttgaataccaataaaaaagtattaattttgactgcaaattacggaaacgggcatgttcaagtggccaaaacgctctacgaacaatgtctgcgtctcggcttagatgtgacggtttccaatttgtatcaagagtcaaatccgattgtttcagaggttactcaatacctttatttaaaaagcttctcaatcgggaaacagttttatcgtttgttttattacggagttgacaaaatctataataaacgcaaattcaatatttattttaaaatgggaaataaacgtttaggccagctcgtcgaagagcataagccggacattattatcaatacatttccgatgattgtcgtaccggaatacagacggagaaccggaaaagtgatccccacgttcaacgtaatgactgatttctgccttcacaaaatctgggttcatgaaaatgttgataaatattatgtcgccacagattacgtaaaggaaaaactgattgaaatcggcactcacccgaacaacgtaaagatcacaggcattcccatcaggcctcaattcgaggaatcgatgccgaaagagccgatttataaaaaatacaatctctctcccgacaaaaaagttcttcttattatggcgggagcgcatggtgtgctgaaaaacgtaaaagaactgtgcgaaaatctcgttcatgacgatcaggtgcaggttgtggtggtatgcggcaaaaacagctcgctgaaagaatccctcagcagcttggaaggtgacaatgccgaccggctgaaagtgctgggttatgtagaaagaattgacgagctgttccgtattacggactgcatgatcacaaaaccaggcggcatcacactgacggaagcgacggcgatcggcgtacccgttattttgtacaaaccggttcccggacaggaaaaggaaaacgccattttctttgaagatcgcggtgcggctgtcgtggtcaaccgccacgaagaaattttagagtctgtcacctcccttcttgcggatgaggagaagctgaaccggatgaagagcaatattaaaagccttcacctccccaactcttctgaagtcattttgcaggacattataaaagaatctgaaatgatggccgggaaggcggatatggcattatcgtaaaagaaaagcacacgaacgattcgtgtgctttttgtttttttccggttaagctttgttactggaaaaataaagataaaaaatagggagcggccgcttgacgcccgctcccatatggtgtatagttgaaccatcatttaacaacgtttacatacgtacggttggatgatgacaaaattttttttagcacgaaggtgctacagtactaggaggaattaagcaatatgcaaaacggtaaagtaaaatggttcaataacgaaaaaggattcggcttcatcgaagttgaaggcggagacgacgtatttgttcacttcactgctatcgaaggagaaggatacaaatcattagaagaaggacaagaagtttcttttgaaattgtcgaaggtaatcgtggacctcaagcttctaatgttgtaaaactctaaactcaatacatgttgatcagatgacaaatagaggagaggcgtatgcctctcctatttgattgccgtctgaatctcaattgcgacaagattctgcttacagcgctgctcgatttcttcaatttgtttctccattgacggcattccttttttcgccatttccgctaaacttcccagatcaccgtatatttctttaaatgtctgctgaaggattgtttttaaatcattatcattcacggctggtttttcccttctctcccaagataccctgaataatagtaaataagccctaattaatcaggttcaatagttatatcggcttattttctatatttttttctattttccgtacatatttctaaaaaaaatctccaaactatttgcggaggtgttttttaatggactctgaattttttccaaacggactgacggataaacgccagcttgaattagcggtggaaacggcccagaaaacaacgggagcggctacccggggccaaagttcaactttggtggagtctgcttaccaggcgattcaggatgccagaacgatgtcacaatccagtgaactgcaagctctcgaccaggattttctgcaaaagcagcgaatgcttctcgacgattgccagcatcagcttgatgaattcgaaaaataaaaccgcagaagctgcggttttattttttattgatttgtcagcaccttgccgtaggctttcagcttctcccccaccgtgcattggttgatgcagaaagaatgagcgtgcgtttttccaaactctttgcggaaatgcttttttacgaaacagtctttgcaatattcatcctgaagctctgtcaattctttataaatgctttttttatccaatatcagtcatctccgttaccttctaatgttatgcggctttcaatctgccggtccgagagaatttttctggcaaggtcatccgcttcttgattttcctttcggtttacggcttcatatgtcggtgtcagctttaaggattcgagcagcgcttcaattttatccagccattcgttttgcgtttcatcataacacggccagctgccgtcaagctgatgcaaaacgacgagggaatcccctcttatcgtgattgaatttctgcttgcgccaagttcctgcacttccttaagcgcttcgtacaaagcggcatattccgcctcattgttcgtctgaagcgttaagcttttgtttttccgtatgcgatgccgcttgccgccgagagaataatacacgacaattccgagtccggcgcgtccgcttgttttgtcaaagccgccgtcgaaatacactgtaatgtcgtcaggttcgtacgcaagttcttcagtaagcttttctaattctttaagcgtccagctcgcgcctttttcatcctcaaaataaatgtcttttatataaggaaagcggctgacttctcttgcaagcatgcgcgctttcggaacggtcagccaatcttcggaaaaaaacgcgacagggcctgttccttttgcttctatttcgatatacggcttaagattcattgaaatcaccttaccattcattagttgacgggcgtgtgctataatcaaaccattctcaaattgaaaggaagtcagcaggttttgtttaacgatgtgttatggatcttatttgcggtcattcattttatcattgttcttctgttttataaaggatttggcaaaacgggcctattcgtatggatcggtttcgccacggtgtgcgccaacttgcaggttgtcaaaacagttgagctgttcgggcttacggcgacactgggaaatatcatgtacggcaccgttttcttcgcaacggatgtgctgaatgaaaaatacggtcccagagaagcgcgcaaagccgtctggctcggcttttccactttgctcgctttgacatgcgccatgcagggggctcttttatataaaccggctgcgtcagatatcgcgcagcctgcccttgagacgattttcggttttctgccgcgtgttgcactcggaagcctcttggcttttattttcagccaaacgatagatgtttatgtatattcagccattcggagaatctttccttcagacaggcttctctggctcagaaacagcggaagcacggcgctcagccagctgctggatacatttatcttcactgccgtggcctttatcggcgtttattccgcgggcgtatggttcagcatctttatttcgacttacctgattaaatttgcggtatcactcatttctgtcccttatgcgtatgcggcaaaacgaatgacaccgaagggagagtgacggatgatgcctgctgaaatttacgtggacggtgcaagcgccggaaacccgggcccctccggtatcggtatttttattaaacatgacgggaaaacagaatctttctcaattccgatcggcgaccattcaaatcaggaagctgaatttctcgctttaattgaaggaatgaagctgtgtgccgcccgcggatttgagtccgtgtcattccggacggattcagatatcgtggagcgggccgcggaacttgaagcggttaaaaacaaggctttccagccgtttgtggatgaaatcatccgcttaaaggccggatttccattgtttttcattaagtggattcccggcagacaaaaccaaacagccgatcagctcgcaaaaaaagcggtccggctgaataaataaccggaatgaaattgcgtttcactgttcatcctacaaatgaggtgaacagctatgagaaaagaaaataaaggccggcagaccgggggcgtgaatcctcagggaaatatggaaggaaatgcgcataaagacccgaaatcagcccttgaaaacaacgcaaaaaaaagcaatacaaaacgctagagggatcagctgatctctctggcgttcagcttttcgagcattctttcaattccttttatctgatggcgtctgagcattaaggatgcttcttccatcttcaatgaaaaaatcgcttcttcaagcgtacagactaacggcacctcgcaatgtatttcagcaagctgccttgacagctccaattctttcaagctttgctgaattttcgtttgctggcccttcggcaagagagcgaggctttctaataaccgttctatgttttcgtattcacggatcagcttgtacgccgttttttccccgatccctttaacgccgggatagttatcgctcgtgtctcccatcagcgccttaatgtcaatcagcgcttttggcggaacccccgtttcttctctgaatatctcatctgtatataccttataattgccgatacccttttgcagcagcgctacttgaacttgatgattcatcaattgaagcagatctttatcacccgttacaatcgtaatttccgcttctccggaaaatagggcagaaagcgtaccgatacagtcatccgcctcatagccttttatgccgatgtttaaaaaaccgagctctcgcgctgcttctttcgctaaatcaaattgcggaatcagctcaagcggcggttcgcttctgttggccttataatcttgaaacaaatcattgcggtacgttttgcttcccatatcccagcagcagacgacatgtgtgggctgaaacgtatcaaccgccgtaatgagatgctttaaaaaaccgttgacgccgtttgtcgggattccgttttcatttatcataaaattgcgatgaacggccgtcgcgaaaaacgagcggaacaaaagcgccatgccgtccacgagcagtaatttgttattcatatatcgaaactcctttttttattcaatgttcctattttaccaaagaaggcggtaaaaaaacagcatccccccatttggaagatgctgccgtcacgttactcaccgtgtcttttattgcttgccatcagcttttcagcttcacggccggcataagaatcaaatttctgtccgaaaccgtttttctttttggcattgttattctgctgaacatttctgtttcccagttttgttctgcccattgtcatatccccccttagagaagatacggatagtatgtacagcaagcgctgatgacacacgcggcaggttcatccattactgtctgctgacgaattctttcaccatctcttcacttacgaatcgtctttgcggcacgatgccctttttcgccagctggttcatttttgcggtaatgccattgatggcatctgtcgtgaacggttcattctgtctgcattttacaatggcttcttcaatggcctgttcacgctggtagtcaagctgtacaaatgttttgacgtgctgatgctgttttgcggaatgtgctgaaattgctttatggacttctgacataaaaggtttcatctcgcttttttcattttagtctaccacgactgttatctgcccgccaaccggatttttaaattttcagcatttcatctttctttttccatgctttttcggcttcgtaaaggtgttcaatttcccttgcactcgtattttccgcaagaccttgtaaataagtgtcccgctgctcgcggatctgggacaggcttttatccgccatgtcttcttgcagacggcgcacctgctcagtatatcgctctgaaaggctttctttctcctgctcaagccacttttctgtcactttttgcaggctgagcctgagcccttctacaaacgctgcttttccgttctgttcaaaaaactgcttcggcgatttaacttcttttatgtgatgtgtgaatgccgagacgtcaatgaccggagcgacttctttcagctgaacggcaaattcgttttcggcgctcacataaatggagaaatctccgtcttccataagcttcttctgacagttttccatccattcctcagtcatatggcgctcaataaaaccggtcatccggatatcgagcgttttcagctcttgaatatattcaaaacggaattccttgagcgcttcattcagcgccgctgctatattttgtttccaatcgccgttttgaaggcccggatggaaggcggttttcagcatatcattcgcataaaatgtcaggcgatgtttaatgtgatagagctgttcttccgtatctttcatcacttttcgaatgatgacctcagacgtacggcgctttgaaatgtcagcgagagctttttcataggaagactccagatgctgtttctttttctctttttcttctgccgactggtgaagagattcgtgaagctgttccaccatatcgcacaatttgtccgcctctgttttcagctgggcgcagctggccctcattacatcttcctcaataaagtgctcaagtccggttcttacatcagagaacctgttataaaaagctgcttttttacccgcaagctcttctttacttgagacatgatataattttggccggttaattccctcttttgagagttctgagcggacatagtctttgacggtttccagctcgctttcggttttggccagatcggcggcgttaatgacaaaaaacattttatccatgccgaatgattctttgacgaggccgagtttcttcagaaaagacctgtctccttttgaaaaagaatgctgatagtacgtcatataaaagaacgcgtcagcatcttttatatattgaaaggcaagttccgtatggcgcttgtttatactgcttgctcccggcgtatcaacaattgtgatgcctttttgcgtgagaggcgaatcataatacacggtgacttcttttacgcagcaggccgttttttcttcggcagcatacggttttaaatcttccaccggcaccgtcagtgtctgcctttgacggatctgttcttcatacgtatcaaacgcctgcagcatcgtctgaatcaccgggataagttcatccggaactttcccctttttaatggcataattccatctctctttcagtgaacgcccctttacatcagcgtctttcagctcagtcagctgaagcatttcagcgtccagatcctcctccgtcttaaaaacgatctccgcagatttatgcggtttgccggcttgcggtttcgttattttgttaatcgtagccgttgtgggcgtcggtgatgacggaagcacgtattcaccgacaagcgcatttgcaaatgatgatttaccggaactgaatccgccgaataacgccaaggtaaactggcggttttcaagccgctcaatcctgcttcgaaaggcttctgcctgttttcctaatatgctcgaggattcaagaatcccggcaagctcatagaaccgatcagtctgctcttttataggaagttccttcatcgcatttttttcgggtttgtttacttcatactgtacagtctcttttggtttctctttttggacgggcgcttttgcaaggcgtttttttcgcgtataccagtcgccgcttcccgtatcacaggtcaattcttcttcccacaaagcgcggacccgggctgctttttccaaggcattgcgttcttcttttgccgattgcgcgagctcatcccttatcttcttttctttttcgagccggtttttcaagttctcaatgagcggtccgttttttgcctgaacataagcggtaagcttctcaatgagttccgctgtctgtcttttggcttcccttctgatcatctcagcgaggtctttcgtataagttaatacgtattcagatgaaaaggccgctccctgcttaagggcctgagcggtgatatcatcagaaagcggtgtgcggtacgcctggattttcttgatcagttcgtccgaatccgcttcataccgcttggccgctttcgtaaatgtgtcgataatgtgccaatccgcttccccttccgttctttttttaatatcggcaaaaaattcagcatgccttctctctttctcctgagccgttttcgcttttgaaaagaataatccggttttaaatgagggctgctgtgattcaatataagcagatgcaagctccctcatctcaaagggtgtcaaattagcgttttgcaatatgttctgcacgtcttttctgatgtctttctctgctgtttcagcctgttgaacggctttattaagctcatcttcaacagaacggacaagtgcttcttgtttgtcaaactgctctccgcttccgtttttatcatcttttacgagcatctctgtatgctctttgactaagtgtgcgacttttctctccgttaaggaccataaatttgtttttgcctgctgtttcagcttctgcagatgttttttcagctgttccatgccgtttaaaggatggtcaggctcagtgacagacgtaaagaaaagcgattctttcggtattcccgcgccttcaagcatatcttccacctgcctgcggtactcttcaaacttcgtttcggtttcatcatgcctgtcaatttggttgacgatcagaaacaaattcggaatacggtctttgatggagctgagaaacagcatattttcttctgaatgaacgtgattataatgaacgacgtaaaataaagcgtcagcctggtggagaaccgaagcggcagataaaaaatgcgcttcgtccgtcgaatcaattcccggtgtgtcaatgtaggccgcataaggctctgactccttaaagccggcatagacttccaccgtttcaatttgctcaccgtctttacagaattgctgcacttgttttttatcgtaacttcctttaatttctgcataagccccgtccgtcgtatgaagcacgactttatcttcaccgtgccggatgacaacgaggttggcgcttgtgggaatcgggcttgtcggcagtatgtcttcaccgagcaatgtgtttaataaagaggactttccggccgaataatgcccggtaaacgcgatataaacctcttcatcagccgcttttttcataatggccgcgagctgatcggcccgtttttcatcctggtgatccaataattgtacgtataaggcacccgttctgctgaaaatctccctgttatggcgttcttcttctgtcatgtgtcttaacccctttgtgtctgtcgcatcaaatgacgttttcatttttagaaagctctgaaaaaaacctctcccccattttacacaagaatggcccacttttcttcaggaaacgtaaaaaagccgccgatatcggcagctgataaagaaaaaacacccgcggcattaaaaaccgcagatgtttaagaagacatcgatttattcgaaacttttttcaatacgaaaccaattaaaacactgtatgtacaaacggctgcaaataaaaataacattgtcattttcggcaccaccttgaatgagaatcattttcatatttacatcttatcatgagtgagaatgattttcaatctctattttgcggtgttttcttctagcgctttctcttcggcgcgaatccttacagtgagcatgcaggcattgagaatcgaaaagagaaacagtgtccaatacgctccgtataacagcggcagaaaaataaattctaagatgacgaccgcgtagttcgggtgcttcatccacctgtacggcccctttctgacaagctccgcatccggcacgacaagaattttcgtattccaataccgccctaatgataatagagcccaatacctgatcccctgtacaaataaaataatacatataatggcggcccaccttggagaaagcgttttttgaaacgccgccacctcagctgtaagagagacaaaaaagagcacgtgcatcaggacgagaaagagataatgtccttctccgtattcgactgcgccttgctttttcaccttctgctcattgcgccgggccacgatcatctccgcaatccgctgggccgcaagcagcatgataaacagccaaaacattaagaagcccccttttcccagctgaacagcaaaagctcagacgaaaatcccggcccgagagcgccgatcagccctttttcgttttctttctgccggccgcggagcaactgttcttttatcacatgaaaaatagttgcggaagacatgttcccgtgtttttgcagcaccttccgagatgcctcaagctgaccggtgtccattgaaagactcgttaaataggcgtcaatgacctttttcccgcctggatgggcaagaaaggttttaatgtcgtgaggaccgacaccatattctattaaaaattcatcaacattgtccttcagccactgtgaaaccagggtgggaatatctcttgaaaaaatgacttgaaaaccgctgtcggtgaattcccagcccatcacatcttccgcatccggcatcatcaccgattgagtggcgaatatccgcggaagaagcggctgtttgacgtcgtttcggttcgccttttctcctccgactagtactgcggcaattccgtccgcaaacagggaagttccgattaagttgctttttgacttgtcgttcggctgaaacgttaagctgcagagttcagccgcgatgacaagcacgtatgcttcaggatatgcgcggcagtattcgtacgccctggacaggccggccgctccgcccgcgcatcctaagccccagatcggtatccgttttgttttcgcagaaaacggcagctgattcatcactttcgcttcaatgctgggtgtcgaaagcccggtgctggaaataaaaaagatcgcatccactttttcataaggaaagggatttgttaaacaatccgggtttgttaaacaatcaagtgccgcatccgcactgtgcttaacggtttcttccgtatacagccggttcttttctgaaaaaccccgcgccgttttataccattcaatcggccggacaaactgccttgattcaatttcgccgttttgaaaggcttttaacagccggtcaatatccttaaatgaatcggcaaacatccctctcgcaaaatccgccgccgtttcttgcgagacatgatattccggaatgctggttccgaccgataacacatatgccatgcccatcacctcttcacataaaggtttccgcttttttcctgaatgtatgcataagtttgaagcgaggatttcactgacatgccattttaatttaaaattggcccttttgaatgataagccgctcgactatacttgatccattcataaaaaaaggttgtgataagaatgctgaagcccgtcattcttaaagggtcactcgttcagttagagccgatgacgattgatcacactcaggcactttgtgaagctgcttcagaaaataggacgacttacgcttacacccatgttcctgacggaatcgaagaaacaaagcgttatattgaacgtacgctttccgattatgaaaaaggacttgcattgccatttgcagtacggaatcttgaaacagaccgaatcgtcggaagtacgcggtttatggatgcggaagtgtttacgcggccggcggacgcagccccggaagtgtgtgagatcggcagcacatggtatgcctctgccgtacagcggaccggtgtcaatacggaatgtaaacttctgttgctgacccatgcgtttgacgcgtggcaagctgtcagggtgacgctgaaaaccgatgttcgcaaccagcgctcacgaactgcgattttgcggatcggtgcccaatttgaagggatccgccgcgcgcatattccggctgtcgacggcggcctcagagataccgcctactactccatccttcgggaggaatggccttatatccggcaaaacctttctggccggcttgcagcatataactgaaaaacctgccgatatatacggcaggttttttacatattcggatcatggacgtataaattgagatcgatccgtccgtctgacgtgaccgctacgccctcagcttcaagagacagcttctgtacagaaaatatctcttcatctcttaatccgatttcaccctttgcattgatgaccctgtgccaaggaagacgatgctttttactcatggagtgaagaatcctcacaacctgcctcgctccccgcggacttcccgcaagaccggcaatttgaccatacgtcatcacttttccttcaggaatctgtttgataatggctaccgcccgttccgtaaatgtcatgtaactcctcatttcgcaagagcagatgattttcgagaaaatcatctgctttctgatcttatttttatagatgataattgcttcatcatcatacttattacatctctgcgtttaaatagattatctgtttgttcacaaaaaattaacaaagataggcatgtacatgtttaacataatatgtaataatacaattgtattaaaaaagaaaaggagtgtttgcaatgaaaatgaaaaaagctttagccggctcagccctgtcactcgctttactctgttctgccgcccctgcttttgccgcaggtcctgctgatacaccttctgcagaaagcaaaacgaaggaagtatctgctttggcgacgttcatacttaatggttatggccctgattatcctacttcaatttaccggaatggaatcacctattatttagacaacatcaccttccatggtgctgatggcacttggacagccgtctacaaaagctgatttttcatgacggcggaatgattgtctcaagtaacaactaaaaagctgctaatataagggggctttgcccctttttttagtttcactccattttataattgatccagcatatagcacctaggtgcgtaattttattacatccgatgatcattattagttgtaatgtttctgcttttagacgcaaaaacacataaactaaaattctctcccgcgtgtctatccaaaagccgagtctcaactctatcaatccagaacattttatcgacgcctgagttccccagctaacgttaagaaacctcttacttgctctttcatttttgataaaacacaatctagggtgataacatgagatttgcttgggaagaattaattataattgcattcggaatgattttactgagaatttcagggagaaaatccattgcacaaatgaccatcgcacagacaatggtgatgatttcaatcggtacgattatcgttcatcccattttagaaaccagtttattgaaaacattaatcgctgcgtctatccttttagtgctttaattttgatggaatggtttcaagtaaaagtaaactggattgattttttttaaccggaaaatctaaattcgatatagaagacggccaactaatatacaaaacttaaagaagctgagactgacagcagatcaactcgaaatgcgtttaaggcttcttggcatttcaattaaatatgccactttagaagctaatggacaattaggctacgaattaaaagatgactgtaagcctttaaccatcaaagattttaaaaatgtgatcgacccaaaatgtcttaacaaagagcctcagccacaaaaagatgatcaagccaatctattcgaggaaatcaaaagacacagactcagcacaagccaaaaaatcttgaataattcgctgattagtaaaaccttttgttattcaaaaccaaagccgaatcagaccgttaaccgcgccgatcattttttaccagcccgtttttcaagaaacaaaaaaacatctgaagcagatgccttttttcagacgagatccttgtatgcgcctgaatatgcttttcagccgctatacccaccgccggccttagctataatgttaatcagtttgtttttataaaatcattgattaattgatcagtcgttaatattgtggcaaattcgtcatgcaatgtagccagagatatattgtgaatagtctcggcatcataatatgtatcattttggtctttcattccgaaggctgctgttgcatctgaaatgaggtaggtatcaaaccctaaattaccgctcattcttgtagttgttgaaacacaatggggcgtagtcaaaccagttattacgacagttgttatatcatttgattttaaaatctcttctagattagtcccgataaagctgctgtttactttcttggttataatgacctctttatccataggtttaacgatctcctttatagcaaccccctcattttttggataaaataaagaaccaggtttatcagaaatatgttgtatgtatatgactgtccatcctttttctctccataatttcagtattttactaatgttttcttccgcttttacgttatttcgttctccccattttttataatcgaaagctttttgtacatccacaatgattaaagcttttttcttttctgccaccagataacctcctatattgaaaattagtatttataacattttaaataaagtttttacttttgtacaattgtttcagttttaaatttcatatcacacctttcccgttggaaaagcgctggaatagctaaatcaaacactcactcaaaggctgcagctcaccagaggccagcaataatcaactctttttctctatatacatatcagtatcctgaaataagctgcaacagcggatgaaaggattgccccttttgccatccactcccctaaaaaaattcacgctgcgcccacaaaatattaacaaaaaacctcttggttattattgtattttgtgtaataatacaattgtattaaaaaacaaaggagtgtttaaaatgaaattgaaaaaagttttaactggttctgccttgtctctcgctttactcgtttccgcttcccctgcttttgcatccagccctggcaatacaaatagcgactcaactgaaacaaaaatttcgacacaagcgatcaaagattcttttacaatggattaccttcatagatgggatatcccaaatacaactgttaaaaatggtgttacttattaccttaagaaagtagagataatcgaagggttctatcgcgcaacttttgaaggatggattaattaaaagaaggggcttccccttcttttcactctcttttgtaaggatccgtgcacaagacactcccctcagcgcccattctgcagttgcacttcggcatcaggcatttcattccatgtctaaaccaagtttcgtgtcatcaccgtccgaacaatgatattcgtttatgatatgatcccccattctcctttttttcttacattcagtcatatgttcacgtacatatagttcgggacggttgttcggcgaaataaggcggatgccgcatcactcaatttatttcttttcaaacaatgaaactaataaaaaaagaggatgcctcacaaaaagttcagcaaactttcggaagcatcctcgatctcgggatttcataaagaaatgttattaaaatgttatttttttaagaaaaacggataactaaccctcttgaacccttgtcacatcaagggtttttttcgttttaggaatcatattataaacaatattcaaaaggacggcggtaaagcttccggcgacgattccgtttgtggtcagcagatttaagtaagacggcaggtgcttaaacatatcgggaacgacagttacaccgagtcccaatccgaccgaacacgcgacgatcagaagattttcctgctttttaaagtcaatttgactgagcattttaatgccgtaggaaatgaccatgccgaacatggccaccatcgcgcctcccagtactgaagacgggatgatggtcgtgaaggctgcgattttcggaaaaaggccgaatagcattaaaagtgcgcccgtgacaccgatgaccgcgtttttcttaatccccgtcagctgcacgaggccgacgttttgggaataggccgtatacggaaaagcattgaaaatgccgctgatgaacaccgccagaccttccgcgcggtagccttttgctaaatcacgttcagacaggcgcctgtttgtcaggtcaccgagagcgaaatagacgccggttgattcaacaaggctgacaatggcaacgattgacatcgtaataatcggtgccgcatgaaatgtcggcgtcccgaaataaaacggtttaatcatttgaatggcgtcagcattcgccacattgtcaaattgcacttttcccataaaatatgcgatggccgtcccgatgacaatgccgattaaaattgaaatggatttcaaaaatccttttgtaaaccgataaagcagcacgatgatgacaagcaccgtaaatccgagggcaaggttagccggatcaccgaaatccttgctgccttccccgccggcaatatgattcatcgcgaccggcattaaggtcatcccgataatcgtcacaagtattatagtttaagtacaacaaaaaaagagccggcttaatggctcttttcttttgctaataaattagacattacttcattcacttttaggttgactttcttaattgcttcagctgatggttgatttatgctttcaatcgttatatgatatttttctatttcaaacgattgctttgaagatgatttaacgaattcactcatacagcgctcacactctgctgttcttttttaatcaaatcatcgcaaagcttattcaagtaatatgtatagttaacttttttcttcatcgaacggacttctgtgccgatctcttcacaaattgcaattggaatgctggctttgtttactttattcttatatgtatgtttcaattgtttttcagctatgttcttatatgtaaggaaatcattaatatgtacgaaataaactttattttccggctctctaaattgaaatagaaacccagggattacgtttggatattgcgtagcctcttttaagtgttttatctgctgcggctttataatcttctcttgaaaggcaatagacttatcctttgttgatttaagctctaatgggaataagtaccccttaaagtgcaagaagcaatcatatttgttttttgatactgcagctcccctttttaaaaacactggattaacatctttaattctatagaagaacagcttttgacctgcagctgatttttctatatttgcttcaaaaaccttgccttggtttgtacctcccaatcaatcactctcctaaaatattgaaactaaaattgaaattagaataaacctttgctacactgttttatgttaattaatattgaaagaagtgttcgaaatgaagcaatggacacccctgcgccctcgtttaaatgaattaatgtttgaatatgacctcacagttgatgaccttttcaaacgtacaggataccccagacaacgtatccacgattatataagtggagctaaagcaaatatgaacttagctactggcatgacttttgctgatgccattggttgctcaattgaagagctgtacgaatggaaccacgaagaaagaagaaaagttaaatcttaatccctttccgagcccatctgatttcctgcatcaattcttcattattatccgaaaggttgattaggttacggtgggctctttcgtattctttgttctcgagagcttctttcaccgtacccatttgtctttccattttgttgaacagtatttgaatgttcttaatgtactcagttattactctccacctctaatcatctaattttatttttactctaaataaatgaccgattttatctaatgttcacttcaccttatttgattcaaaagacaagtgtacccgtatccaataaagtgcatcgctcgcttcatgaaaatcacctttaaagaaattcttcgctacactttttaataagtagaaaatatgtctccagtcgtcaaacttaaaactcataatcctctttatcattgaaataaccctccccaaatcactcctgctgcaatggcaacaatgaaaactgaaacaaatttaattacaccaatatacactgcaaatttaagattcccttcggaatccattcttgctaacaaaacaagcccaaatgcaacaaacaaaatccaagctgtaacgatcatctacttagaacctcttccaactgtatatccgccggcaatgtcatttaagatcgtggtaccataagaaacctttttactctcattgtctttatttttagtgtaattaatgaaatcatcgaactggtttaaatacactccgtaagctgtgttattcaatttataaacggtatcgtcacttggtttcaaaaaccagctgtcagtaccttgtccatatacttcaaaaacttgaacaatttcgtccttatgctcaaagtaagccagcttattttcaagttcacattcctcatcaactggatttccaacatgatttgtagcatattccatcatagaagtaagcatgtagcctaattcgacgtccgagaagcttaactgtggtttaggtgttccataataaatatctgcttcatttagtgatcctctttggttcacttctttaatgatctcttcgatagctctgtagccttcatgaatgatgaattccctacgttcctcatctcttcgtttatactcctctaataaacttgttaccttaaactctgtattcttcatctaattcctccttgtatgaaccgattatttctggtatccgttgaaagaaagtaataatgcaatccctagcatcatgtgggtattcgcaatcaatttcggcaccggatatgtaaatttcatattctatgctggatattagttgaggattataaggtagctcgaactgtaggcacatcctcagattaggtatctgttcattgacaaacttcaaaaacttcttctcatactcaggaacctgttcatataatttgtttgcaagctcttctatggtgtctgattgcaccttataaaggttctcaaacaatgttttgttaatggtcattagctcacttaaagcttttacagttttctgatttccagttagagtgactccccaccatttaagttcctttgtgatactctcttgcatttgctcccataagaaattgctattgtacccccttagtttattagaaagttgtttagactcgatatgtgagccattactgaaatgaatattaatctttctctctaaactattgctcacttttgactaacccccttaatcgttcaacttcatcaactaaccattcagcatagctaattttaattttcatcatctttgttgatctaaattctctagacattacttcaacaaatttcttaacttcatcaaattcaatctctttcattgaacttatcccttctaaatgaaatcaacattttattcagtatcaacaaattcaaatcttgatctgaaaaattcatcgtgttcataagccccatattcattgtctttagttgcaatgatatgttcttcacctaaatcatcaatgatttcaataccatcatcggttatacgaaaatcatattttttatttaatgtaaactctttgtcatgacagtctgtaacatatttaattttcacattagacattttactttctcccttctgtataaaattagaatttcatttgatttcaaatgtcttcagctcaaacgttttatacgtatcaacttgcttacctggtatctcatttactctaggatacatatcatagtcatatggatatccaatgcagttcatgtgaaagctcgttccatcattgtcaaactcagcttgtaaatgatcatgaccacaaacccaatgttttgcgttaatgaacgggacatcaaccatatagcagctgttaggctcaaacggagaataaggattgtgaacaggtggaacatgtgagacaaatacatcaatgtgagagttttcaagagtgtcataccagcccattgattctttccacattgctcgtaccccatcttctttgctgtatccattaaggctgatatagtttgaatcattagagacacctttgaagaaatcccatccttcatttccttttggaagataccacataacatctcctgcaaagactttccctttgtatgtatccgtagactttattaatggagtgacattattgatgtctgtagccttctgaattaaatcattcacccttcccaatgaatcggaatattttcgttgctgatttttactgagtaaataaagatcatgattaccatatgtgaagtaaaccttttcatactgctttgctacttcatcaagtacccacagtgtctgttgattccactcagtaaaatcaccggcaatgattaatacctctccatttccattcgatatcagccttctaataatctcccttgttcgcctttcccatttaatttggtcattgtcccaaggtatccagtgattaatatgcagatctgaaacataatcgattttcattttatcccccttctttgtttaagtacgtgttaattcatgctccatgaccaattgacatttaaatcccctcactttaaattaatgtgtatatttacaaaacatctccacacaatacaattgaacaagcttgtttacatacaactttaggagatgatcatatggctcaacaaaacagatcaaacaacagcaatgaattacttgtgcctcaagctgctggtgcccttgaacaaatgaagtatgaaattgcttctgagttcggtgtgaacttagggcctgagacaactagccgagcaaacggttcagtaggtggagaaatcacaaaacgtttagttcgcctagcccaacaaagcatgaatggccaatttcattaatgtatgaggggattactcccctctctttttatgctcctcttccaaatccataaagtactactggcattgtattcacctcctttagtgaacaaatgtacttcgtctaaccagctcgtttaaaacgatttgaagttttcttctttggtcttttatgtatgcattgttatcggtacgcaatccatcattaattctattttgtatgtctgttttcagtctctctaagctttcaattggtaatttttctagactaactttatatgattgattcattttaatagcccccagcaaaaacgagtgaaattatcaataaccaaaagactgctccagaaacagcaagaaagctttttgcaatactcataaactcttgaaaatcattcttcaacgactctttcactgcatcaccttctctttaaaatacagattttacttagatttcagttgttttgaactcttgtttactcaacagctctaaatagacacgattacactctgtaagttcatattcttttttctgaagtttcctttcaagctcagttatataatcgagaagcctaggaatgtcttgccgagcgtttgcgatgaagtccgcgtcttctttagttactgcagctgctaaaccatcctcaagagtaactatccaataacgaagattttcgttccctggccattcatggtgaatgtttgcatgccaaaatcctttggttgtcgcttccatacgttgacggatttcttcgagttgatctttcgttaatttttcattcattcctcatctcccactttcaattaatttgattctcaatttcctcaataaatccctctaaagcttcttcatcaaccattacttgtccaacctggactttgatgatttctttcattcggtcatccatatttctaaattcttctgcttgctgcacagtaaacattgatctgtatttctttatgtataaaagaaattctttaagtacaccgatctccccaattttgtggagattggaatcttcttgttccacttctagccggagtaaagctgcttccttttctaaaacatcaatttcaagctgttctttctttgacagcaattcttgctctttttgttgcaatatatcacctccttaaagttctcaccgaagaaattcacactccattcagaaaattcaccatatattcacaacattctccatttatttcaaaattaattgttataatatagttgtattacatacctaaaccaagggagatgcttttaatgaagaaaacagcaattgctttattagtttcaactattggtcttactggtgtagctgcgtcagcgaatgctactgctaaaagtgagccggttgccgcccctcaaaataatcttgaggtcttaacaaacaccggtagttttcatgctcttgggactgatactcacgttaaaaatggtgttggtgaagtcaacataggtagatctacttcaggccctgcatcttacgcaacagtagtcactagctttacaccaaacaacgtaaccaagatttccatcatggggaaacaatggtcaacagggacaggaagtagaagtgcaaatgtgacttatgaattaatgaagtcagatggcactgtgctggcttctgttacaccgagtggcggaaattatattagtgaacaattttacaaagtatttagcgtaaacacatcacttatttcaggaaaacaattgtatgtccgagcacataacaatgacagtgtagctcaagtaaaagttaatgttgatgtttattgggattataattactaatacattgagagggcttccctctcttttttatttaattatgtaggcttgtttttaaaccgattcatactgtaaatgcttgtttttctttttgctaattttatattctgcaatcttcagtgattcaagagtccatccattattgtttaaacttccgaaaagcgtgttcagtaattggagctcttgttttaagcttcttcgctttctcaatatcttttgacctttcaacgaaaggtgatatccctctgaagcattaaatttgtcctcttctagcttgtgataaaattcattgagctctttatcaactttccctagctctttataaaggttatcaatttcattttgaagtcgttgtttagtctcctcaattgcaacaagaggtttggaaatggaaacaagataatctgttgcagttttcatatcgccactcctatttattattttatttttattctaaaagtatgtaaaaaaaagacaagcttttaacttgtctttatcttatcattcaacttctaaaaagtctataactattttatttttattctaaaattattttgagtaagtcacaaatgaataattaaatgtggtattgttgtctgctttcctgtgatccttttcaattactctccagtcatcatttaacctgggaaaatatgaatctgccttctcagcaactgaatcaacaatcgtcaaataaaccttatcagcatgtggtaagaatgcctcgtatatagcacctcctccaattaccattacttcttcatctttatccaattgtcctcttataagctttaatacatcatcaatcgaatgataaacaaatgaagagtgatcaggcttgaaatccttatttttagtcaatatgatattctttcggttctgaagtggctttcttgtaatgtttacgattgaagcgtatgtaagtctcccctgaatacacaactttcctgtagtgagttctttaaaacgtttcatgtcttcaggaatatggtaaagcaaattattttcatacccaatggccattgatttatcgcagcaagcaataagagatagcattatactgctacctcaaagtaaagcttgtctccatgcttataattaaccaatttgaaatcatcaattgtgaaatcataaaaatcttttacatctggattaatccataactcaggtgcttcatactgctctctgtccatttgaatctttaaattgtctatatgacgagtatatacatgacagtctccgatattgaagatatactcacctagctcatagccagtaacttgagcaatcatacgctgcaatacattgtactggaacacattaaacggattcccgagtgcgagatcattactgcgacagaaaacttctaaatgcaacttcccgccttttacaagccattgagtaccatagacacagggagtcaatgccattgagtctaattcatcaggattccaaagcgttgtaatatgtctgcgtgatgatggattatttttcaactgatgaagaagataatcaacctggtcaaccttttcaccgtttagcattctgttcttcttaccaagctgatatccatatgctttgccgattgtaccgtcttcttgtttccattgatcccagatatgtacgcccatcttgtttaattcgtcaacatcatttgatttaagctgccatatccaaagtaattctctgattgccgttttccaagcaacttttttagtcgttaaaatcggtacttcggaattatcaaagcgcatttgcttactgattacacttaatgtatgtgctggtgttccatctgtatcccacttggttctgacatcgaattcttcgtcagatgccccattattaattatgtcatttatgattgtgttgtactgcatatcaaactgagtcataattctattctcctttatctaaaccaactgataataaagttaaccacgaagacaatattaccgcaaacaaaaagcatgtacacgaacttgttttgtttattgtttgagtcaccgtccaaaacatcaagaattttaaacattgttaaaccggtatatattaaagcaaaagctgttcaagctaacattagcaagttaccatgcgtaatcagtccaatagtagccaaggggataatgaacgaaatccccttgaacaatgtcatgacatacactaagttcttattcttcttcagttctttatatggtgagttagaaagcaaatgtgtgactttagcgtatacgttctgttcccctcgagtaattaatctaatttcattaatgtttagtgcaaataagtatgctgcaagtattaacgtaaagtatgtaattataatacatccccctattttattttttagagcagaggaattaaatccaactgctctggttaaatttattgatagatcgggtcgtagcagtttctatggcaccattcaacattgccatgcgtttggtacatacatcgttgaaaacatcgttcagcactattaaagtgggcaatgtatggtgtaaattgtggcaagtaattcaaagtatgcagcgacggtgtgtaccatattggatattgtctaaacacattaaaacctccagttcttcacagttttcaatgtattgtatttaagttcacacccaatcgatacttgtcactgtttatatagccatgtttaaaatttaaatatcaatcaaaaagctcgccggctctcttcatgtctttaatttcttcacttacactttctttgattgtgtgaggtaactgatcaattctccgttggattcttttctgacctgtatttcttatatgtaaagttaattctttaaacccttccattgattcgtctgaaattaaatcaaactgatgttgaatcttagctaataagcttatgtattcttcttcatcttcactgaataattggaggccttgtttaaaattttctatttcttttagatgggcttgtattttctctatatgtttatccatttttcttcacatactctttgacaacatcgacaatttcatgagtattgtggaatacagtttgccctaatgaagtggcatgagaataaagagggtgattatcaatatttttaatttcttcttgtaaacaatcaagaaggattctttctgttttcactgacacttgttctaacagccaactgttcccgttgtccatagaaagctgaattcttatttctggcggcaagttcttaaatgcattaataaagtcgtcaaccttatattgatcagtaggatttagccttgttttaattgaaattttcattttcaaatctcctttttgttttaatttgattctaataaactcaaaaaattaactgctgcaactctatacctttggtcttcttcataagctgcaacttgtttcatatgctccaaaaacacatctgcaagcccttgtttttgaataaaccccaaacaaagtccgtttctgaagagcatatcatcatactttgcttgcaaatctttatgactgttattgtttatggtctgtttcctcctctttattttaaataaaagtcttcttttatagagatgttcgttcaatcgacaccctttggtatccctaagatctttatcaactttagtcatcacaatttcgcttgtttctaaattttgaacttgtacatattccctttcctgtctacatgatagtgtccttttggataatatacatgtccatctgcatttaccttatcaattacattaaacatgaattcgccctgttttatattccctgtcatccacgcctttttgcgtaatctttttttcatccagcatctcctttgtaggcataattgttgagttttttgagtattttaagttgtaccctggctgagaccctccactgacaaacatcatgatcaaagccaggggtttaaactaataaataatatctgccacgtatttagaccaagattctaaacgattaaatactaatggattatcaaaatcttgtttatttaaccaaaagccttttaattgatctgtttctcttacagatacctctgcattttcaggcagtttaacaataatcattatgcctaaatgaactttccccacttcatttaagtcatcgtttatcaaccccacaacttctaaatttaaattggaagttgagataaacacctcttctgaaagctctctccttaagttctcatcaatagcttcccaaaaatttgttgcttcagttaaattcatgtgcccgccaacaccaattgataattgatcatgaagcctcttttccccgctttttcttaaccgctcgtatgcaaatactcggtctcctttttgtaaaatggcatagggaattggttgcttacagctttgatccctctcagcatctcccctattcatagtgatcatgctttcagcgagattttcgattatttgatcaaccttgcctagatcagattcaattccttgaaagactagttcttcattatcaaatactttatctctaggtgctacaacaattacttcatccattttccccatttaacattctccttttgttttattatgtgaaaaatctatccaaaaattaaataggccgcccaacatgaatatcgttgaataatccagtcaatatgcttaatcttacagaaggttatccaatccattatcaacaaaggtattacagtaattaaaaaaattaaaagcagtatgtacttccaccatgaaatctcgttaatattccaaccgaatatggttagccctcccctaaggaaattatcttttattgtaatccctttagtagttcatcaagttcttcaggcttaaatccaacactacgctttacttcttcttgctcattcagcagtatagtcaccggtacactcattacctcaaattgcgctgccacttctggcttctgtgttacatcaaatgtctcatattcgactcctgcttcgtttaaataattggataccattttgcaaggattgcaattcggttgttctaatttaatcagtctcatgaaataactcctttgctatcgaaaatgaaatcagaatcctttaatggttcaaccgttgcttttttatagccaacgcctttcattgaaaagaagtcatgtgatttagtctttgtgctcaatccattaataacgattggattaacatcctcttcttcaaaccaatgatcaaagcccagattgtttaatgctttatttgcgttgtatctgatgaatttctttacatctggagctaaaccaacctgatcataaacatcttctgtatactccaattcattttcataaagctcctgcaacaagcttaaagcccattcaaacaattctttttgcatctgaagagtttgtttcttatatatctcttgagctaacaatccgacataaacgccgtgtatcgcctcgtcacggataattaaatttacaatttccccgctctgcatgagcttcccttgtccataaaagtaaagtggataataaaaccctgagtaaaacaagaaactctccaaaaacacggacgctaccattgctttgaataaggaaatatcatcgtttttctgaactgcttcataaattgaaacaattgttcttgctttcttttgaagaaatttattgtttttaacccattcaaacacttcgttgatctgctctgttggagctaatgtaagaaagatgttgctgtaagattttgcgtgcaccgcgttttccatcatcgccatgaaattaagaaccgcttttcgctgatggccctcgacgtgctcggccacaatcggcatgcccgtgttcccctgctctgtatcaagcagtgtcaggccggcgagcaccttcatgtacgtatcctgctcatttttacccaaatacttccaagtaagaagatcgccgtttaatgcgatctcttccggaagccaaaactgctttacgttttggttgtaaaacatttgggtgaaatcatcttcatgctttgaccagtttgctgctgtatattgcgtcaattattcatcctccttctctttaacgaccatattgaattttttgatttttgctactaatccggacttcttcgtctctccacatctagcgaaaggatacgtactatctcgattccttcctagctttgattcgacgtatttatcgaaactcgcataatccgcccgctcccagaagaaaattttagcccattccggctgctcatcgaatgttatgctttcgtccttaaatgagtctgcacaagtatccactactcctccgtagatcctaaagttttcatgtgggtgcttttcactgacccactcttgaccgatttctaacttcacgactccgcctccccttcgtttaaactacgcaactcaagcacgaatcctggccggtatctttcgtccgcgcataatacaacgttttaatgccacgatgatgcgcgtataaatcaatccggttcagatcgcgcgttgtcatcgtatctttcaagaacagcgtaaatgaaatcccttgatcgacgtgctgctgaatagtggcaataagatcaactaccttaaacatatccatgtcgtatgcttccttataaaagaaccaattctgagccgataaacctggcattggataatatgtcttactgtttccgtatgtacgttcctcgattctctccataatcggcattacaccggctgtagatgattgaacatatgagatgcttccagtaggtgcaacagcttgcctatacgaatgatacaacccatatttcataacatcctctttaagcttcatccaatcttcaatgttaggaatatgttgatctccaaacaggcttttaaccttttcatatttagggctataatcaattgtcacgtacttatcaaaatactcgcctgatttgtaagttgatccgtgaaacttgtagtacgtctcccctgtttcttttgcaatttccattgaacgttgcagggagtagaagttaaccatcataaagtatgtatttgcaaagtccttagcttcttcactttcataagcaattttattttgagctaaaaaaccatgtagattcatctgcccaagaccaattgatcgcattagtgtatttgctctcgcaacagctggggcatttacaatgtttgttttccttgtaacagtcgttagtgagtcaattgctattctaaccgtggaagcaattgattgattgctcattacgtttacaatgttcatggatccaagattacatgagatatctaaaccaatttcgtcttcctgatcgtaatctgtataaactgagacttgtgatgcttggagcacctctgaacagttgccagtaacaatcccattgaaaatcagagagtgatagtcttcttgtgttgtatcataaacatcctcaacaccatcttcttcaatactaataatttcagccgtaaaatcatgctttggctttcttgaagaaggttgcaatgtctcagttagcaaattgaatttataaatatcgtattctttcatttcaacaatgctcataaacaactctcttgagtttctatcttgaatactgattttgtgagttggctttacattgtacagcttagaaccacctttcccgtcaggaaggagttcttgtgaacgcttattgttagaatagatcgttgtataaacacccatgtttagtaatagcttctgaacgtcctgaaggctctcatagtgaatggatgttaactcaattgttaatgctttggctttatgatttgcatttacacacccatcagtctggaataaacctgataaataagctgcttgcgtttccttattagcttgaaaaatgaattctgggactcttgttttagtttctttgtccataccgaacttcttcaagatgtcaaataagactgtactattcatgtagagtaaatcttgtttttctggattagccatattaaatgttggagccagtgatgtattgtgtttataagcacgatcgagcttgtgtttttgaataatacggtgaactgcatcagtaactttctgctcaagaacttttttgttatcgtataaataaatcttggcagttttttcagtaatggttccatccccagctataatgcccatgatgtaagcaagatctggctcatgaatgtcgccgtatgctccctcacctgattgaactaataatttatcgcccgtttttagctgattcaattggagcttttgaatttcaccgtcccttttcacatagaatttgtgccactcagttgtccttatttcatatccttgcttcgttttgactttaaatatttccgcatcttttttagtcaattgcattggaattgcatctactattgaagtacctttgctgccaactgcaaaatcttttgttctattatcaatgaccactttaagctcattctgctttttgtaaagatcagctgctttttcatatccattctcagttaaaagaagtgtttctccagtaacgcacaaattagaaaacttcacttttgaaatatgttcatttggatgcactttatttacattgtcagcaaacatgatatacggatatcctgattcgcttcttagaatggccaattgctctaacagttttcgagcatttccctttgcttttctaactttagggttttcaacaagctcatcatacattttattgatttccatctcatcaagatacttcccatattctttgtagactgagtgaggatagaacatgtaaaaatccttatcttctcttgccaattcaataaatttatcagggagaactacaccaatagacagtgttttaactcggacatcttcatctgctgagatttttttggtatcaaggacgtctgtgatgtctgggtggaatacgcttagataagctgctccagacccttgtctttgtcccatctgatctgcatatctaaaagcattatccaatagcttcataacacctacgacacctttagttgcattctctacgtctttaatcgcttcacccttggctcgtaatttgcttaggtttaatgctacaccaccgcctaatttagacagctgcattgaaatgtcaattgcacgagagatgtcattcaaactgtctcccacttcaagtaggaagcaacttaccatttcacctcttcgcttacgtcctgcattaaggaaagtaggcgttgccggctgatactcttgtttcatcatggcgtgtacttcctcaatagccttttcataatcaccatctgcacaatataaagctacaattgagacacgatcctcatatctctccaatatctttgttttgtcgtttgtcttcaatgcatagtcattgtagaacttaaaggcactcatgaaagaagggaatctgaatttgtaactgtaagcaatcttaaaaatcgatttaatctgctcaaatgtgtattcgcttaagaattcttcttcgtaataatcatttttagtcagataatccagtttctcttttaagtcatggaaaaagactgtgttctgattaatgtaatcaacaaagtagctgtgtactgcctccttatccttctcaaattgaaacttaccgtctttctgaatcatgatctcattattgagcttaatccactttggtattgtgtttgtcaataagttgtacctcccgattaatcttctgcaaatcttgttttgttccgcttagttcaaactttaataacaatggtacgtggaacattgctgagagcttgtccccagctaaaccatagttatcaccccaaaccttgttaccactcacaacaactccttttattttatttttattcttaataataaagtttaaagtcctttcaggtacttccccaaagcctatcgtatatgtaatatgtataaattcttcttcaatgattaagtcatctgtaatttcaatgacatcgaagtttaactccctttgtaaagcttgagcaaaccttttcacattgcctgtcttgctttcatatgtaataatcaatattctttatattctccgttaaccaaactgttggtggttgtttctgcttcattttcagcatgatgaaaagcttcagacatttctaaattaatgtctcccatttcagcatagcctttggccatttgagcttcataatctgataactctgtcattggtactggaatgtagttatccttctgctcttgtgtgataaccatttgatccccttcaagattagtcgcaatcagctctccttttaaagcagtgtatgaaccaccattcttcatatgtacttgcgtattttcttttgcttcatccaaggttacaaagtgactgcgcttaacgtataactgtttagcagctcccattccacaactcccttttctttattttttgtttttatctttgtcatgtcttacgtctaacttatccatatcatttagaatatggtcaataacaacatcgctgaacttaccgtagaccttatatccaattaatttgcttctcaaatctctccactttcttgctgcactcattttgcttccccttcctttgaaactgtgattttatctagaaataactgtagcctgttttggtttatcaatgtatggatcaatcgttttactcaaaacatactccagagttttgtatctaccttccttattttttttggaaacatagaagttcgccaagttcatccagactaatgctgaaaggatcattacctaccttttctttaaatgcagttaattcactgaatttttctttgaattctataagttgctcttgattcaaactatcgattttatatccaagcatttcaacaagttcaagtcttctgtgttcaattagttcccttaattttgatctcaaacccaagaacttttcgtcttttctctgctcagcaataaactctctaatattcattttcatcatcctttactttactctcaaagtttcttatctataatacctttaatgctttttaatgtttgcttgtactcgctatccaagccacttacatcaagatttgttgagattcgatagtttcctgagttgtcatacattgtgatgaaagcctcagtgtcatcttctttagcgctaaacgtgatatcatgaacgtcaacctgatctgcaccgttttcttgctttagttcttcaacatagtctggctgcatcatgttgaataactctttaactgtggtgaattttacttgttctaataagctatcttctttgtattcaaatgtctcaaaataaagattgaatgttatatagccttctacaagatttccatacttagtgtattccatcctatctactctccttttctgatttctcttacttcatgcggcactccactttcttcttgagcatacacagcatcattatgagcctcaatagcgtcatcataagtgttaacaagtgttcccatgcaataaagtccgtattttttattcattttcatcatcctttcgtggtctttgaagtttattgatactttcatacagcttcatgagctcatttaatcttatttccacttcttcaaaatcatatcgactttgaagaaacaacactctttcccttaatagaagcaacacttcactgatagctttatcatgaccaattatttctgcaattgaatttgtttcattaatcgattccatgatatatttgccctgtctttgacttattcccagatgaattcacctccttgtatttttatccgttaaagtaaactgccctcgattagtaataccatttcttcatcattagaaatctcttcaagaacctgcttaaatggcataagctcttcaccttctcccggaacccttccttgtcgtattgccgcataaacttgtccaacttcagtcatctcatcacttaattccccgtcatcatcagcaacttcttttgtatataacttcattgccttttcttttgagtaagctttaattaacgcataatagggatcgctcacttcgaagtacttcataacgggcttctcaactcccaattcctcaacgtaatcgcctttgatttttacatcatcaacaccgttttcgagtaaattatctacgatatcctttcctagctgttctaacgcagccccttgaacagattcactttcgttattaaatccctcatgagcgtaacaagttgcttttatttcaaaaactgctgctttaatccccatagccaattctccttttattttacttttgtgaatctcttgatctctttcccatcaataatcacttttccaaagaacaccgtcttggccttcatatgtaaccaacttttcttctgtttcagtgtgaactgcttctccaataaccatatataaaccgcctttataatgtctatcctgacaaccgataaaacaaatgtgtctattgtagctttcctccttaaacttcatctaaatgaaacacaagaacatttttatatggatctaattgaatttcattgcttgtttcttcaccatcaattctgaattgaattggtgtatctccgttaaaatcaagttggtcttgtagcgctttaattacatcgctaactttaggattaattaatttcccattgatctcatcataagccatagctattcctccttttctctctaaaatcatccttttattacgacctacagaactgtgaattcaattttaattaaatcagaagaaatgtcagttaaccttttccttgtcctaatagtctttgttttgccttgacaagttgtgatttctaaaatcgtaggatcttctatatgaatactagagtcacttggtttaagatcatctttatttgcaatctctaagaatacactcctttctccttcatacatttcacaatcatcaaaagtccctaccaatgttttttcatttggaagaaaaacgttttcagtcgttttgtacagttttacatttctcattttcattcttcttcatcctttcaataaaataaaactttcatttagacttcaatcaactgattggtatctaacctttggataggttgttttcatataaacttttttcatgcacaatgggcattgaaacggatatttcggtgggtttgatgtgagcatcatatttgaaaacacaagctctggagcttcttcgcattcatcacaatgtaacgtctctctaaaaactttaacttgctgcgatttaatcatattcagattcctccttcgttaaataaacaatgtactgacatacagaacaatcaatgcaaaagctgaatgaagtaaagacttaccggctttcttgaaaatgttctcatctttttcctgatctgaccgttttacacctttgacaaatacgttgagtaaaacaccaatcacaaatgcatgaggtaaagtgatatgggtattttgaatgttgtatgtatcaataagcaatgggtttaacacatgattcaatccataatagacaactagtgacatagtcactgcttcaacaaaaatgagtaaccccactacaatcagagaacctgatccgataaagaaaccgttccaaatatcttttgtatccttattcaataaatatctctcctttagtcttttttagtgattagcctcttccaccaggaagttttacgtttcttttcttgctctttaaagcgttcatagtcttgtttaacttgctgattccatttctctattttttcttgtttttgaattgctttttcaaggctctctttatcctcaattgttttaatgaccttgtcagtctgatatgtccattcattttttgtgttgcgttgcctgtctgttacgactacgtattcgttaaaccctgggatatacactttccctccgacttcaattgggtctaagtcgatgttcccttcaaaaaatgtctgatactcacattgctgctcgattgggacaagggcatcacacaagcctaatgtccaacttttcttaattaccttcccttcaaatgttgctttatgtcgtcccacttattcacctcctactgttgcatctctttcttaaaagcatgtttcaaatgttgccaaaatgatatccttttatttcctagctgattatcatgcttttcttttactttactttcgtctaaatactcccttaattgtttttcagcttgaattttactctccttattctcgactgtgctaatgacataatcagtgaagtaaatccatcccccatcaagcattttgacctttttttctatatgaacattttcatcaagttcatttatgtaaagagtgtcaccacagttaacttcaaaattaatttcatcctcataaaaagtttcagtagatatatctaaatactcgtggtcaatagctggtggctttcgtttcgcatggacgccatgaaaacacgatggatatgccctgaaaaggtaaatcttttctattttcttgcctttaaatactgctctacacttctccatgttagtttcttccttctcacatttcattaaatgccgttattgccaccaacagttgctttgcctcaacttctgctatttgatctccaatttgaacctttacccatgtatctggataatcaatactcttagttgccaggagtttcagagtttttctgtttactcctctcaatgtgaattcggatgtaatgtctctcatgtttttctcctttctttataaaaattgaattttaacctaatttctccaagataattttaagataatctttgaagtcaatagctacagcttcttcaccttctacacgtttctcatctcttacgccaaaaaaccatctatcacctacccactggcttgcagttatattatttctcccgaacacatcatggcctttgaaaggatttgcctcttctattttctctagcatagaccttatgtctgtgaaatacttagaacgttttttaaatgcatagaagccagcttttgtggggtttttcaccacttcatctttaaagaagtcatatgcttctgttcctgcgcgtactccgaaatactcggaatgatagaacgaaaaaccattcttaattccgtatgttgcttcgaattcatcaaagaatttgttaatatcttctcttcgtttcttctcagttttataccaattgctttcttgcttaatctcataaattggtgcatctaatgtttccatggctctatgctccttttttgtttatcacctaaagacatcatttgttccaatttgtcgcatactgcgctttcccaggaaatcatttatatttcctttcactatttcccttcatcttgttcatatcactgtaagaataaatccgataaggagcgagcaagctcccattaagaaaacagtgagataaaatggcaaggcttctttaaagtttttattctcaactaaacttgtaagtccattacctatgaatattgaaccgaacaagattagtcccagcaccaaatatgacatttcattctcccttcttataatggactagattattactcatggtattcatacgcctcttgaactgcattaaagtcttcattatctaaaacatcctttgctacttggcaccaatatcctaaatcactaaccgcttcaactagttcattaattgcttgatcctgagtaattggttttgaatctaatatccagcctccattaacagttctttctaacgtatgagcaccttttttatgtaaacaaactttcaatttatccatttagcatctctccattctcgataaaaggaatattttatttttactcttaaagtaactgcaagtaatccaatgtcttttctaatttcatgtctttacaattttcaatgcattctttcttgattgcttctccgcattctttatgtaccgcgaattccttatattctttgttgtcagctattcttatgtaataaacgatttcgccaatgtgatccttgcatttaacacactccaatgcatcacctcgattcttatatttctaatatactcgcattctctcaaacaatcaacaactattttatttttattcttaaaaagtttcttttaaatttcttagctttactgttgctgccaaaatatccgaatcacacctcttccatatacggttatcctctggccttaaattgttctctaaataaacccaaagcttatctaatatttcctcaatctcatcaacgtcattattaatgatatccctggcagtatccctaattatccgatacctcctctacgagaatatgattatagctttcccgttgtcattctttatgtacggcgaatgttttctctgaaggcaatttgtccccctaccttccccaatgctcacgttataaacagtctttaccttatgtatgtctaatgccttccgtttagcctcttctgtagacattgcttcaattaccaaagacgcgttttcgcctttgtgatctttacatctaacatagtaccttttcaataaacatccctttatcctttcttgttatcttgttgtattaatcttcttttagataagacttgaagaactcatctaggtttgcagcaatcgctccagcaacttctgcacaatgagcatgactcttttcttgagatcttaaaaactcaactgcagacttagcaatggcttttattttcccctcgtctaatttgccgcttcttacttcatctttaattttttcggcttcctcttttaagctttctgggtagttcactacagactccacctcttatattttatttttactctttaaaagacaaattttatagcgatttatataaaggaaaaacagtcctgtcaacctcatctagataaacctctatatctctcctatctagattccagaagacatttttcacaataaagcacctcttatcatttatatctgatgacagatctcctcctacaatatagtcacctgtacgaggcaccattgactctaatcttaggtggtttccttccccatccttactatatgtaagctcactcaaagaactgccggttttacaatcattaaaaataactaaccatctaacttccatttcacaccctcatttcgataaaattgatcttttatttagatcaccaaccgtaaaataatattgtctctttctcaaaatctatggtttttaataatctgaccagctcaaaaatactgtattcatatttccaagaagatgttagccatgaatcattaatatccgtatttaacgcccatcctctagtccactcagataagttgttcttaatatgctgctcttgttttactgaagcagttccatttttatcatcaataagcaagttctcgtacattgcaatgactttgtttttataaatttcaatagcttcttcaagcccttctttaccaacaatatatggaacataatccgataattcattcataacttcttctctttcaaagagagggtgtccctttgaataaatgcggtcggctgtatcatcccaatacaacttcccaaactcccaaatttcctctttaggcaggttacctatatagaaataaccttcttctcctattgcaccgaactttttggacaattcattgtaattcattgattttatttcgtttacaagttccttgctgattttatacatataatgtctataacccattacagtctcccctttctctttaaaagagatattttaaacagtttcacaaacacttcacacatttcaaatatttaacatgctagactggagatgtaatcacaatcaaaacctaggaggtaattcttatgaaaaagttttacaaaggattgattgtttctgctctattgcttacagcactagcactccctgcattcacatcacaggcttctgctttaacccctgtcaaatcaattgatcaagttaagcagctaggtgatccgcttggtacagttgattttcacatgctgaggaattctaacgtatctctattaaaaggctacacccgatgggaaattgtatctggaagcaaccttataagcattagttccagtggtgtcgtatcctctcattcaactttgggcacagcattggtttacgcgtatgacattaacgacaattatgtgatttataaaattacagtagaagcacgttagtttactaaggagtgttaattcactccttttaactttattttcactctaaatataatgatattttaaagtaatttccgttcaatctcctcccaattcataacacgaataaatctattgtcattcctgttatgcggtgcatcaaatagtatcttcattccatcaaatgtttctaagttatgcactccgtcatcaatcatgatgtctgctttaattatgtttttattgccacaaagcacaacattactatgtggaatatatggaaaatgctctgtgagccattctaactttgctttaagggattctggatggtttgttgctgtagtaacaacatatacttcatatttcttcgccagctccttaactgctctctgacttccttctataacatccagatttctgaataattcgtaatccaaatgcctgtaaacattgttttgggtatttgaatatttgctaatatcccagcacagtatatcttcctcttttagaaaaggatcatcataggtgttaatgtaggctacccaatcacttagtaaatcggctaaaacttgatccatgtcaattgcaattactttcttcataaatcaccccatccgttaaaaagattatgcctttagcaatttcttcgctagaccactgttctgtatcccatgaatatgtatgtaacccaacatcgctcattacttctctgtataatcctaataccggctcaatatcacgatcatttatgtattcgtcaccacgttcaagtaaacgctgcttaataactttcggatcagcatgtaagtagatcaccttggctttatccctaatcttctcctcgatgaccctttgttgctcttccgttaagattgagtaatccttgaacttcttcgcataaactaaatttgaatatatgtatcggtcaataattacattgtcctcatcagccagcttgctaaagtgttcaaacagcttctcattaccgctcttagctaattcaaagctggatccttttattaccggatatccgagttctttgcttagcttatctgctactgttgatttgtagcagcagtcagtgccttctaaaataatcatcgtcatttatcttccacccttcttacattgctgaagccaatcactctatatgagccgtctggatactcaacttctaattgctcatgtcctttatcaacttgtgcaacaacaccaatctctcctgtgaaaccagcaatcaccttctctccctttttaaacatacaatcaacctcctttagctggatttaattcatgctccttgaagaatgtaatatcacctgtttcatcactgactgcgtaatcatatgtggcagagtgtagcagctcaataattttcccttcccgtccaacatgatgaggacaagcgttctttgcattctcatttatgatgacttttaacccttctggataagaccaaaacttcggcaattaatcgcctcctaactaataattgagattgtccccttttgcttgccaaaattaattgcgtcacgctcggttgctacaagcaagtccactttatttccaacaattgctcctccagtatcaattgcaattgctttgaactttttcccaccaatgcttacttcaactattgaattcaagggaataacactagggtcggttgcaataacacgataccctttgtaatagattgattgagtgacatcaacacctgttctagttgttcctgtgcatccttcttggcagtgggcaatataagcactcagcttaacctggatggttttctttgcggccggtggcttgttttctttttctttaatactaattttatttttactcttaaaaagtttatgctttaccgtctcacctcccttcctgtgcctttttttactttgcttaggtttaatgagttttgctgagataatcttctctgtatgcctttttaattgctgttctttgttagtttgagcttttttaaatagccgtaagacaatattctcacttgatggtatcctaatctgtctaggcttcttataaaatgattcttttattgagtcttcatttccctctgttttatgtaaatgttgctcataacttatgtaagaaaaagtggttaagggaatcaaaatcatcataccataaacagacttgaaaatgtgtgttttaattttatttttactcttaatggcgatgcatatcacttctccttctttgttttctttctattcgatattcctaaataatcatttattcgttttttggctatctctatgtaatattccttatcaagataatcaggaacttttaaatcaataacgttatcattatttataaagcagcgcggtggagtatttccgattttttcaattcgttcttctgttttaaccttgaaaacacctttagcatcttcatcattagaagcaaaaactcttaaaactttttcaggtagcctttcttctccatagagagcgtacatatatttgtttgaaacctttgatatcttttgaaattctcttaactgatcacattcattgatggttttttcaactggaatatcttttgtaaaatactcaatcatagctttattaacaattggtaagtcataatccaggttgtttagttttttaacataagcacctttagatttatacttctggtctttatcaatgattatatagttgtttacatccttctgataaatcttctcataaacatcccactctaaatctaatcgtgttctggtttcccactccttcgccacttccttaattaaatcaatatcagattctttctcaactttcataaacaacccatcagtatttgactgaatcagtttacaatacggttcaattttctcgatcaaatctaataacaacagctgcccggctaaacatacgttattggccattaacgggtcataaagtggattatactgatctttcattgctccatacgttgagtttaggacgatcttgtagggagcctgcttaggatcttttttgcgttttaattctaaccgtgtatctctgatttcagtatatttcaaagggtttttcacgttacgactgatgtaatcatattcaatcatgattgaaggatatagagatgcaacatcacaacataaaattatcccttcatctttatactttggtaatgccccatgtaaacctccccaggcaaaaatatgaggtacacctgcaacatcaacctttaagttttttttataatctagattttcaggatttctataccaatcaacaatgtgtttgtatttttcaatttttaatgtattaggaaatctaagttcaaactcatctcccctgtttccttgcttttcagcccccaagataaatgcagataattgggcttttgtctttgtaaacatagacatttctaaatcaaaggcttcaattaaagccaattgactttcgaattcctcttttttattatcaaacacttcaattgtttgtttcacatcgtgaatacagtactcaacaacttccttaatttctttttctgttaatgctcttgcgatatcaaatggtactgatgactccttaatccttgaacccataaagccttctagctgctttaagctgtggaaaccagttgttatgtcaaagttattcagtgggatcttataaccttctctaacaacattaaatccctttacattatcattaataattcttgaactaatataataaggattcattcctaacaggattccctttaaaatgtattggtcgtacattctagagttgtaaccaatccaaatatcatctttaaacatcttatagaatcgtttcagttcatcaacatcatctacaataaccttaccctttttagtatcataatcgatcagcacaaccatccagttatgtttaaaaacttcaaagtcatagaatatcttcctcatcattaccccctaagaaaataggttatcaaacaaatcggtcttatcctttttcttaaatttatttgatgatttatttaaaaaatccttataaaacttgcatgtttttcggtgaccacataagacactgcaataaaaggaattgtatttatctattttcactggttcccattgggtttcatcttcacggtctttattttcaatctttttaacagtaccagtaatataatctttcagttcattaattttctcttcagtaacttcgtattcaactaaacaatcttcaagccaatacttatttctaatctcggcaggtaagcagtcaatgctattttcttttactgcgttatctaacaataggtcaatttcgaaatcatcatactccaaagtgcgcatctctttttctagtttcattcgtatttcctttacccacttacctctgttacacattttctttttcactttggtttttccttgggtacatacataaacgtatttcaccatgaaccatagtattttatctacttttaagtcagttgtttgctccaatgcaagcttgtacatcaatagctgtcttcctgcttcatttaatttcttgccggcaaacttacttgatgtcttccagtcataaatactaacgtatggttttcctttttcactgggaaggattgcatctacatatccttgaagataaatcccatctgatatttcaaatacaagcagcttctctaaaaccattttgctgtcaattttattaaaattgtttaggaaatgaccaatgtctgctttccagctgtctccgattgagtcactcggaaagttgactccattcagctctaattcaattaatctattttcaaatccctttttaaattcaccaatgtctaattcatttttataaatctgttcaattccgttatgtaattcagaacccataagggtgtaaatattatctatgcctttctttttcaaaacgtatgtattgtagtattcatattcacagttattaaaggttccaagctttgaaaaggaataaatgtttttcccttgttgtctcaattcatttaatgtttctttcaatcaatcatctccttttcatatccaaactgtacagtctctgattagacggtgtagagtgcttttatcaaggtctgctggtgccatttttgatcccttaggcagatacttgttttcacgatcaaatatgtacccaacttcattttcaaagaaattttcaaactttaggctgttggcaatttctacgctatgttcttcacctaatccttcatccatcatgactaatgactttttcggaaacattgattttatgtgatttgcttgaatttcacttaaaaagctgcctcctaaagaaactccaacattcaatcccttacttgctaaggccattgaatgtttttcggattccccgatcataacaatgctcttttctctaattgaactgtaattttcaacaaacccgtatagcgttttggacttgggaaatgaaataataggcagccattttgtttcctcatcattaacttccttcttattaagacgccccattacaccacacaattcaccactaagagatttccatggcaccgttattcttccggaaacactatcgtaaccaacctggaacaaagattgagttaaaggtaatattccatcctcataaaacaacttatttggaacagatacaaattgatctaaaatgtcatcggaatacgtttctagatccaaatccattggattacttagtcttcttatattcttataaaaacctccgaatggtaactcaggtggtttatattcttcttcacttttataatcaactatttcagatatccttttgattgttttgggaaaagataaacccaatttattttgaacaagtgttatcaagtcaccttttaagttggttgaaaaacaggttgcacctaaagtggttttatttacttttactgaagtcggatttcttcctttttttctcgcacatctgtactcattcccgcgttcatcaacattgtaaaaccccgtctgttctaaaataagtactatgtactctggcttttcaataatgtgattcttaagatcatatacgtccatgatttcaccgtcccttggtaatcatgtccgctctgtagttctctgatgtttaggagtacaataaccgagctcattccatttattccatgcaccgtcaaattggtataacaacactgtatcgccttcgtcattccgtgtcttattcaaaaagaataatctatacttcttatttgggtctaactgaatttcttctttaatgtttgtaaattttcccgacgagtcttttttgaatctatagggtttaacatcgaattttcctcctgggaattcatcctcccataaaggtcttgttagaactaactctgaaacaatctccttaactgctttggcatttgataaacaagacgctgttagatatctcgtattctccatataaatggccaactgcattgtaatgatgatgcaaatatcctctttttccgcaacttgcaataactgttttgaggcttcaattagctcacctgttacattggttgaagccgcatcttcagctttaaatgtatcgtaaagcatataaccgaagccttgttttgccattcttctcattattctctttacatcattaatgctgtaatcatatatcttggcaaatttgatacgccccttgtaatgcttctcataatattcaattgccttttgtaacatttccttttgctcatgctttaggttgcccattttttgtttctttcttggcaaaccataataaccaagtttatgacttaaaattgttgccataaaaatatgttgccaagcccttttattcatttcattggcgataattgttaccttttcaccctgatctaaaattgacatgatataagaagaaacacaaaaacttgttttccctgtcccactaaatccagcaaaaatttgaacattagatttatgaagtccaagcgtgtgataattcaataatggacatgcagctgaatagcttaatcccatttcttccccgttttcaattgattcgacaaactcttcattcaaatcaagatcctcaattttcactcctgaaccgcgacctagaaaaacattatctaattgaaattcaaagtaactgtacaattgttgactcgtcatcttcttgaatttatcaagctcgttcgaaacattgaatcccttatcatgaagctttagtatcatgttaaatttaattagttcatcatagtatgtctcaacattttcatcgtttagtacgtgcttgagttcatcaatggttttcattccacctcgccgaataaaaccattttttaatgtttctttaccttctatgtagctgaaaacactcgcatcatcaaagctcttataattcatgttgctcagttctaaacctagagagtaataaaatttcccgtcttctgttagaaaatctctatccgccctcacgtggtctttataatcctcatacaaatcagggtttttccataaacaaaatataaagcttccttcaatttgtcccctgttttcaactaattcctttggataagaatctaagttgttcaatactcgtcctccccatccagaaactctgttatattttttggtgaattgttttgttttaaagatgtggaatcaacgatattagtttgatttacaattgcaatatcaagattatgatttttttcaatcattctctgattttgttcatgcagccattccttataaacatcattgatgttactttcaacaatcttaaaaatatagctaatcatcccatactcgttgtaaaactctttattagttaaccaatattgaattgtttgttggttcttctcaaagcaaatttgtatcacttcataatcataaaatctttttagttcagctatcttttttagaaaaattggaggaatgacttgaccctctctataattcaagacatctttcgctatgtagtttaagaggttttttcgtttcaccttatcattgatataggtttcatattcatccttagtacagtagtatttatttttccccttatcatcagaaaccctgaaaaaagtatcaacagttccattagctttacatatttgacatacacatcttctggccaagaataccctctcctattgataagggggagactccccctcttttccttcagttagataatgcttcgactatcttctcgaatgctgtagttggtacaatgtctacacctttaaaatctttcatattaaattgatccataattttcttcatttcacccttagcttcggcagttgcattagggaatagtgtcttaatctcttcggccaacctctcattctcttctttatcaataaaagatgagttgttaacttcgttgtgaatttgaatttctttaatttgctcttgttcttttctttcttcttcaatgttatttgtattatttttttgtttatcaaaagccacatggatagcttgttcaattgctttaataaattcattcggatctaatggaattgatggtgtgatatcggagaatcttgactttgaatcaatattaaagttgtcatctctaaaagtgatgattcttgattcatcaacaactgttcccactgttttgtcaggcccaattttttgttttactgttttcttttcaatcgaccgattaatagatgctactcctaaaacgtgcagcttggttttaatcgcattgaagtatttatgtgtcatattggttgtcagcatgtcgtattccaaacccgtaactacgtctgtcattgttcttttcttcgtatgacctaaaataaacatgctaataccgacctttttaagttcccacatcttctcaagaattaactcaataactttgtcttctcctgcctggaaaccaccaaacgctgctttaattgtattcactcttttttcaggattagctttattatgtagtcgaataacttctggttctgtaattttaattaactcatcaaatgtgtcatatactaaaacctttaaatctgcataatctgttgttctgtttttaataatatctttagtaatttcattaaaggttgtccaatcaggaacatcttcataggaggcatttgggatggcatcgatgccatcctctttaccaatattcaagattatatacccatctgctccgactaattcttcgcaaacttctttagctaaagttgttttaccgatccccgattcaccaataattccagtgttataatcgagaggattaactttaattttattctttttaccaaattttcttgccatatggataaacatctccttattgtttttaaataaatgtcagttaggtcttttcaaatcaagcaaataaatcatcaaatgcattatctttttcttcttcagtcactttaggttcttctttttctacgggtggtgtagaattttgaatctgttgtggaatatatgtaagatcttcaatttcatatgtagatgttgcagcaccttctgtaaaatcattagaatcattaatcttttttaaaataggttttaaaagtctattttcttcacgattttcgcccaatagccctcctttaggtttaaagtcatctagtgtgtttaaacctaaagcaatcatttccttttgactttccgtgagttcctcttcggtaaactcaatctcatcagcacccctgaaaatattcacaacccattgaaggtgatatacttcatcattttcaactttaaagaagtttttcaagagatttaatcgtttcatatgtaaatcattttcaaagtccaatttttgtgcattaatgactaattgctgaggaaaaaatcgatctttttttgcctgattatcatagctaagcacatatgcatcaacaaagtaccttttttcttcttcaaatgacgattcatctaaagattcacttgtgaaaaatacatccattgtggctcttagttgagatggtgtatcactacttacaatttcaatggttttgattttgaactttctaaaattccgtccattccatgaattgtattcaatattacctgtaattttaaatttattgtctttatgcttttcgagattttgggataagtactgaatagcatcgtattcatgaatgaattctgcaccgtttatgtttaattgtttatattctcccttgagagtagataaagttttattttcttcttcagtaagagagtctttcatttccaaccctctaattttaaacttcaattcatttaatttggtttttgttgactcatcgtttaagttaattaggatcttagaaaaatcagcaaccatgtttactgtttcttctttcaaccgatcttcccatggaatttcgagtcttgatcctttttcattttctgtacccttgctgaatgaaaacactttattttgtttgctttttgagtaaccaccttcaatctcaacaaaaacactgtttgtttttgactcttgaactgcgaagcttaatctttccttaacccatccgctgtcatattccttaatttcatggaatttctctttattgtttgaaataaataggttaccgataaattcaaatgtattataaagtttgctcaatataacgcctccgttaatattatattttatttttattcttaaaatgcctataatgagacttgctactaaacttacaatccttgataccaagtagcttgtttaattctatgtatctcttttttggaaagtcccaaggttcaggatcaccttttacattttcaatccttattactgttccatgtcgaattgtgatctttaagtttccatatgagtatgttttagaaaaaagacctcttttaattcctcttggtttaaattcctttaccaacatcacattcctggttaactttcttcttgcttggtcttcgtcaatgtcgtaattccttttgacatcatttttgtaggtatgtaaggcttcgacagatactttcagtatctttaattcctttttcatctctttcctcctttctctctttgggataacttaatcttacatcaccaaaacggatcggtcaataactattttatttttattctcaaaagttttaaaaagagttgagctactatctgcagctcgacaaagtgcttttatttagctggaaaagttgctaatccttttaaggttgttatcaatatgttttaataaatgaagtttttcattaaaattcgtatattcctctttagtgattttctttgctaattggtattgacttgaatctaattgaactttatgaccgagtttatctttaatgattacatgcttaacattaaatatcctgtatacttcataaaaagagttgatatctagatcatcatatttatttgcgctattgccactttctttaattctattgccatcaatgtctacaggtcgtgtatcgattggtttcacaaaatcacccaatcgaggccttctattaagagttttaaagtaaaccgtttcaccgtactcgttttttgctgttaagaaattcatcagtttctcctttatcgacgatattttttagaatacctcataaaagaagagccgcttaaatagcaactcaaaatgtttatcttattagcctcccactctaactcccatgactcagcctccaatagaattgatggacataataccactcctttattaattcaattataccatttacaaaggagtttgaataatcaaataacctcactccaagaccacatgttcattgtttgcagcgtaaacccatcaggaagctttttcattttaacattcacattgtatctcttcccagtagtcttatggatcacagcaagttcttcaccatcatagaaccgcacaattgcttcattaaattcaattggctgatcaaccacataaccttctttaagcgctctgatatacagataagggtctgtcttataaagctcatatagtctattaccaaagtcttcgtgtttatctctaagcagattaaaattaatcagggatatgtacagtttttcagatatgttcagcttgttcttgaaataccggattgcttcatcttgttctttggttaaaatattggccatatatccatctcctaaacttgttaaaactacagttttatttagaccacaatatctccttctgcagtcttcagtgttccactgtcatatgtgttataaattaaggttgtattctttgctttatctgtgcaatatgggtgggataataacttgccaccaattccgcgcacatcgtttcttacgagacgtaccttgtttgtattctccaaataaacaccatatccttggtctgctgaacgattgaacatgatctcattatcctttaatatatgttctgaaccaccagtcagttggatggcgattaatgatttacagaaataaacctgattctcactaatctggcaactgtatttctcaggggtgcctttaattgcaacattcctaggctcatgaatttcatttcgatgcagtgagacagaagagtctttatcccaaaagatgccgtatccactcccacttaacaacaagtcatttccctttaaacgaactgactgagacctttcgcaataaattccaccatatacattagcaaactcattattaacgagactgattcgggtagagtccattatctttgcagcataagacgagctcgttccttttcctttggtattcacaaccttaatatcatttgagtttctaacctggacttgaacacaatcactgttttctatcctgttgtccgtaattaaaaagtcctctgcttgatgtgttgcaatagggcatgcttttattttttcaaaagtattatttgatactgtgccaccctttcctcttacacaaatgcccacttcaaagccactaatcgtattgccatcaatttgaactctgtttccagactcagtacttgaaacacctaccgagtcaattccataagtcttaatttcattttcattgatgatcttgttatttttgatactgacatccgtgctatatccataggaaataacatggtcgctgtagtttccttcaataattaccttgccgcttgtgtgagctgtaacagatccacgtccattgtttttaaatctgcagtttcgcacagttaatttatacgggtgatcgtatttaattccgttttctccaaagccctctaaatcaattcctaattgtggcccaattgtatctcctccagcttcctctatatcacagtcatcgacaagaagaccttcacaaccattggtagccagattatttcttcttcctcttaaaagcgtacactttcgaacggttacattctttgaaggcgtatatgttcctgaagtgttcatcattccatcagccgctatccaaatgttgtctccaatacagtcagaaacttgtacattttcaattagcacattgctacttccattaacatggataccaaagccccattcatgcgtcttcttaattgaggtaatttttgaataatcatgctcatgtcgatccccaataatttgaccgccacgaatcgtaacattacttgcttggccgatataaaaacaggagtaaccctgataatcatttggctgcactttaaatatagcctctggatgaagtattagctcaatattcgaaggaacattgatacctccaccgaattcaggtaaccgctttgacgtattcactgcatcaattaggtagataccttttggaacatatactttatagaatgattttgagcatgcatactctaaagctcggtttaatccttctgttgtttcaattgcatttgaccctttatcatcaattccccaatccagagcatcaacaaaatagtataagggctgttgcatgttcatgttgtcaaacccttcccttctacattttcattgagaaaccctgatagagtgtcaatgaagttataaaaagtctcatttcttgtaccagagcgtcctttcagagaaaaggtgttgaacattgatttgcgtagtccagtgctcaattccagttgaatgctctttcctgttttatttttattggccacgttatttggactgctaccggatagcctcgtaccctcatctagaagctctgcagagtagccggcattatttaatgtacttgttatcgcttcagctttgtcccggtctgtgccgccaactagaacatgttgatcattacttgcataaccgtgaagtgacaatgtgaactcatgccccttcaacatttcaagtgcttgtggttcatcaaaattcgtactggttaaatgcaaatcaaaggctcctggtgtctttaaagcttcaaaaagatatgtagagtatgtttcgcttaattcctttgcaagctcgcttgttcccccttctatgccacctccatggggagcaagaattaatacatcagtgtcttgctcttttgagaacacgctaaaattgaacggtgattcattcgctttaagctcttcaaagttccgatacttgtccgctgctaagatactgattggattcatgaacgaaaccaatgctgtcaccaatactggaaaagacttcttttctgtgatatactttaatagcttcgtaaccttgcgaagtgtgcagattagagtgtaccgtccaaagtctctcttttctgctcctttagtcttttttagcaattcctctattttgtttttaatcctcaacaattaataaccactcctttttatttttgttttatttttaaaactcaaatcatataaatcgatcacatcgttatcacccccttaaataaaaaattacttttaactgatttgtcttaactgttcactcatataatcaacccattcagtaaaagcactaattataggttgtctattgcctgaatctgcccaccctgcgaaaccaataaaaccatctggattaaaactaattgcttctctttgagtaaaatagtgactgtttatgtaaagataacaactttttaaagttccatttgttttgtatttgctttttattttctgactcattctcattgtatcaacagacattgtatgtgctttaactgcctgtttaacatgcttattgagtagcataactaaagcacaaatatctccctccgtaatgtcttcataactaagtcccttttgcacaaaataatttcttgcttcttctgaagtcatttaaacatctccctatctggttaaatatcgtttttatttagactctataagctcaggatcttcgtaaatgttgccgatgacttctgctttgctgcatctgcagccagtatcgacatcacgagtattgtccacataagcaaacagtggcctttctccgatatagaagcccgcataatcttcccgatactcaacttctaagtattcatcaatatctttaggtggtttgcctgaaccgtacatgacaaccgtgactgttctttttaaaatatccccctcataaatctctcggccgtttttgtcttttaatccggtgtattgcccaactgtttccggcctgacactgtaagcaaatggaacaccagctttattagagatataagaaccaggatcaatacccatactcttgattctttgcttaatgattgataaattgccgtaataccattctccgttgatgcccattcctcgaaacttgatttctctcattcttccgcctccatttattatttagattcttttcttacccattttctaaccttaacttccttaagctcaacttcaaaacactcaacctggtcatcgtattcccatggtctctcctcttgtaactctgtagcgccttccctgtaagttgtctcataaaacttgtcttgatatgcaaacacaatacgataatgaatactccacctagacgtatcagtgatttcttctaaaattgaggattcaggcagccgcaattcatttaccatgtaatctttgtccaatttaattttcacttaagataacccctcttccttcgcagcatttacattcgactaaaggctcattaattttatccattagatcatctagaaatttcttaatattgccctttaaatcctcaacatctttgccactaaacggttctacaattgggtagctctgataggctttaggtgcaacattgtaaatttcaacttcccgctttgtttgaaatcttttctcaagtttaggctttctacgtttgtacattgtatttagatcaactacgtactcttgaggtttgcaaagctccaaaactttgaccacagttaaacagaaatcataatcactcgtgattcttgcaaacttagggtttatattggcttttatatggtttctgataatcttatagctttcttctcgggacaagtaacacggctttgtttcaagaagcattggatgagtttgaattctatccagtaagttataattcaagttaaaattatggctttgcaacttaagttctccgtcaatttcttcaattacattcatttcaaactcaattttttgattctgttgcgggacttcttcaaattttaaattatatagacccttcacttcatagtattcactgtcttcacctatgtaagaagttttaattacttgtggcgtcaaatcagtttcctggaacccctcttttaattcatacctatgattgatttttttagcaggcatttgtttttcaataacacttggctccttatcaagcttaaaccagtctgatttatacgtttcagttgctcgtttcccatcgaaaaacaattcatctaattgactatgaaaatatttctttccttcaatattgtcagacaccaaaaaacagttacttgttttaataccaattagcttcatcaaatttcccctttttaattttatttttatccttataaaatctctgttttatttagattcgaaaagctcagtatcttcgtaaatattaccgattacttcataactgatgacagtcgggtctgattcgctttttaaccaactcaaagcattcatctcacaatcaatccaaggccttaaatcaaatgctggatagttttcgctatccaagaatttaacttctccaacgtaataaggttcttcagcccatgtggtgtcgaaagtaatccgaattatatccccttcataaatctccttgccgttattgtccttcaatccggtgtattgtcgaaccgatttcaaacttttatcagcaaacgaaaattcatcaccgtctttatctgtaacgtaatctatttttccgttatcaaaagaaatgtcatgaacatcaataatttcttcgtaactgtctatacctgcccaatgcatattagaacccaaattgcttaatgtatgtttaactaccaacgcctgaaatttaatatctctcattctctccacctccttttattgtctccactcaaaaccgatattaacgtttgcttgtttaggtctgataacttcaactgtgctacctctgttagacagcctactttttaattccttcatatccttgtatggcgctatttgcaaggtgctcagatcgataagaataacttcatgtttatctttagcggcatactctctgtctagtgttctaacaatgtatacatcagcatcatctattttaatgaagtacccgtcctctaaatctttcacctttggcttatctgctttgttctttctaatctttaaattgatcgccattattctcacatccacttattttatttttatcaaataaatcaattatgtaggcttcgtacatctcatcccaataaggatctgttcttgctatgtatttctttactcttccattctccacaatcttaaaggtttgccccttttcaatatccgtgaacttcttctttgtccatatccctctgatcaacactacaacttcttttacctcaactgtttgccgctgcatcacattcctcctttttgattttcgtgtatcaagcctgtacaatattcaaaaaaccctaaaggatgatgaacatgtgtggcaggttcactttattttctgagtttgacgacatcatcgaacagttcaatatagatcaatttttgtctgaagacgcataccatccaagttataatgtagctccttcacagaacatcctgacaatcattaatgatggatcaaacaaccgtctgggtaagctaagatggggtcttatccctccttgggctaaagatgaaaagatcggctataaaatgatcaatgctcgagctgaaacattggccgagaaactttgcttcagaaaaccgcttgttagcaaacgttgcatcatccctgcggacagtttttatgaatggaagcgtcttgacccaaagactaaggttcctatgaggattaaacttaaatcatccaacctctttgcatttgccggcttatatgaaaagtggaatacgccagaaggcaatccgctatatacctgcacaatcattactacaaaacccaatgagttgatggaggacatccatgatcggatgccggtcattcttactgacaagaacgaaaaggaatggctaaaccccaaaaacaccgatcctgattatcttcaaagcttactgcttccgtatgatgctgatgacatggaagcttatcaagtttcatccttagttaactcgcctaaaaacaactcaccggaactgattgaatcccattaagtaccacagtcattttgctttatatatcaccttcgcttagctattatgttctaagtaggaggtgatattttgtttgtatcgccaatgttattgcattcaatcaaagaaccatttgatgacgatgattatattaccgagctgaagtttgatggaattagactgatcctctccaagtttaatgatcagataaagctttatactcgtcacaacaacgaagtaacaagcaagttcccagaactgttagatcttaatatacccaatggaactgttttagatggtgaaatcattgtagctgccccaggcggtgctccagatttcgaagctgttatggaacgctttatgtctaagaaatcagctcataaggtggtttactgtgtattcgatgtagtttatattgatggtcattcaatcgctactaagccactcactgaacgtaagagtatgctttcagacctaaaccttgaccatgataatgtatttgtaatcgaaggtctacaaggaaacggattagcttactttaatctggccaaagaaaagcatcttgaaggaatcgtactaaagaaagctaactccccttatgaaatcaataaacgttcccatagctggctgaaagtgattaattatgattacacagatgtgcttatcaccggctacaccaaagaggatataaaatttcttctgtcttatcctgatggtactgcagccggaataatggaattcatgccgaacgcagaacgaagtaaattccactctatgaaacatgtaaagtctgaaactgacgaatatatatttgtagaaccgatcttatgtaaggttaagcacagatttaagactaagcatggtaaactccgcataccttcctttgaatcctggagagtctaatctctccgttacataattccttagctcaaagttaattaattttgatgaaaatttagtacatgaatcaattagtttaacttgcccattcagcaaagctgtaggggtaatcaacactttcaatgaaaccgatctccttcgccttctgacggattttcatacaaccttcatagctgtaagcccatatttctttataatccctcagctcgccgtatttccctgttatgatgaattttctgaagctgttgactagttgccacatgttgcccccatgcgaaaaaccatttgcacgcccgtatcccaattcatatgggtaaacgtcagcgcccgtgtaatcatcaacgaagaacagttttttcttaaatctgaaatacgctatccgattctttgacttacagtagaaagtacatctatcaatacttgcgataagcttgatcaaatcgtttatgtcgttcattcgtttcaattgctctgctgttgccatctgcgcccttcccttctataaataactattttatttttattcataaataatcaccaaatgtcatagcctacaaaatcattcaaaatattcgtcattccctcatccccttcttctgtcaatccatattcatcaagcctgcttatataatcttctcgttcttgtttgatcattttttcacctcttttttatttttttcaattcttttttgattttcatattacttttcactcttttattaatagatgcgtgtcatacacatgccatctaagagagataggacatttttgtctcgggaggtgaaatgcaatgaaaattcttatggatctcttcacaacttggatttttgataaagtcatggattattcactaggtgctataatttggtttgtattcaagtccaagtcaaagcagaatgagtatcccgaagactttgaggaaaagcgtcgattcagactttaaattaactgactcgtattctgatcgctatcgccgagcgtaatgacttccgtaaataccacctgctcgaccggcttgataacggcttgcgcgatgcgatcgccttttcggatgatgtacgaacctttcgcaaaatgatcccaagctccgaggtaatcgagagcactgacgattttatctctgatatcgaaaagaaagtccttttcaatatctgtataacgatttatattgtcgacgattactccgacctctcctcgatagcccgaatcaactgttccgagttgcacacgcagtctagtattcagcgtaatgcctgatcgcggacggatttgcatttcgtatccctccggaatctcgaacgccaaacccgtcggcacaagctctgcccagcccggttcgataataacgtcctctgacgccactaaatcgaagccggcgtccgttgcgtgcgcataagccggaatctgtgcgtccggtgataaccgtttaatatttacgttcatttcgtttcctcctaataactgattaaaaattatcttttatctagacttgttcagctctctctatcatctctacaagctcttgtgccttgtttaattttctgctgtagtcttcaacttctttcttcgcgattgccattttatcaaataaaacgcgccagtttccattaggatttctgctgaatgatttaacaattaggccattaaaccagacgtctaaaattagtctgctctcacttgtttcaggtttatgaccaaaggcagcatctttattattaccggcataaacaatttgtttatttatttcatatagataattttcagtttcttttgtaactacatatgtattcattttcccaccccttatagattgtattgactgtctttaattgaattccaatcaaacgtttcaagtatgttaagcaactgctctacttttggtgccctccaagctgtcattgcataagtatgagcttctgaagtgtagtgatgcttgttcaaattgatgtggctcttcgcttcttctttggtcaaaaacattgtatccggccgtacaatatgaacctttctttctggaattaattctgcttcttcatcaatgtatttttgaatccactcaataggatcatcaaagtcgtcatttttcaactctgttaatgcttccttagatagctcactatcttcttttaaatcttccaaataatcatctaaaacatatgcttctgcaatatatggcaggtatacagaataccgttctgcattttcctctcgagcttcgacccattcataatcaccaactgtccagaaacgtggtgcagcttgtccgtcgttgtcttgatttttcaactcttgctgaagttcttttaaaaactgaatatcttgattcattcgtttcctcctattctgtttaaaatcacgattttatgtagactaaacctttttcttgctgtcatgcgttcacacttttgggtaagatactaatctgttaacagtaataactcatcaactttataattgtattcaccgtattcacccgagctccatttaacacctacagagccttgatttgtcacccacaatataattcccatttccccattttcatgccatcttacttgctgccctttctgataaccaagcatgtttccacccctttcttaaaaagcattttaatttaactttaatgtgtattgccttgagaaaatcccctttaattggtaaactcatacctaacttacatacgagtgggtgattccttgaataaaacaatcggtattgctggattaatcatcagcatagtagtgcaatcattttcggccgatgattcgctaacccaaaagattgctacgggtttgttatttgtatcaataattatctataattttgaacatactaaagattattctataaagtcacttgtaattttaggtgtttcctttattgtttttatgctagggatttataaaatcctctctattaccagcgattactttgaaaagcttaatgtgaattttggatacatcctcttatttgaaatagcattgattattgcattagtgtcgattgcagtaaacgtaatgaagtacattgcgaatcggttaaagaaatcacctgatggtaaagagctttgactctttgccgtttttaagctaaatacttcttcttatgtggtcttctatgtacaaaatcaaacgcaatatcgacttgtgccggttccttctcctctgctactcgctctgtaacaacgatcagttgtccattttcctggcggtcaatgctatggactgaatatcctttagcagcgtaatattcaccaataatctcatcaacgtggttgctaagcagattcctctttatcatctttataacctccacttattttatttttaccctttaaatatttatatgtattccatccgcagccatcaaatatgcttatatccgctccaagatgccacttaaaccaaactaagttaaaccaggctgtatcaattatgtatttgatgtatcctatgctaacgacatcctttcaactaatttttcaatgaattcttcttttctttatcaatatctttcttaagcatatcctcaatttcctccaatttatcaaccacttcaaatgtaaattcatcatcattggtatagcgaatctgatcacttgctttctttacaagctcaagcgcaacttgtctcggatctttatagttctcactcaaattcccacctcatttcattgaaataatccttttaaagtaattgcttagtagctaaaatctgatccgaataatgatttgcattcttcttgggtgaatggttcttcaagaaacaactcattttctttgttaaatgttatgcaaagttggttctcccttagaggaagtgggcaatcgccccgtccttcaactttaacaacgtcgcctactgcaatcgttcctcctgtaatcaattctttgaaatctaacgtgtcgtcattatgcgatccccaattaactccatctaaattcacaattttaaattcactcatgttatatccctcctcattcaggcgtatagcttatatccaattcaaaatcacatttcggatgcagcctccaaatttgatgtcctaagtatgttttcctagcgtaattcagacagttccttgtcccacttatacttccgtcataaacagctactattgcttcactgtgatcaatcatgtattcatttcgtttttgcattttagccggtgaaaactcacctggtacagctccactaactttatatttatctaattcttcaacattaataatctcatctgccacatcaagcatacgtttgtaccacattttttgttcttcagaccacactttatcttgttctttgaaaggtgttgcaattatgtttttaatatgtgggtatttcttctttagaatatgtacacaccagcaagcagcctgatcagttcctaacactccaccagttatgaaactggacttgttttccttagtgattaattcttcaattacttcaagcagcttatctttgagtttaagcattgttggatttttcatatcgtatccacccaatttgttcggcctatgaccagtgaagcacaccgttttctttcttaaagtctcctttttttgatatatccgctcacgttcatttctttcaatttccatctgcttaatatattcaggatcactaagttttttgaaagtgactatcggttctcaccctttctttaaaacagtctttttattgtgactgtataactacaattaaaaatctctttccttcttgtttacagttgaaccagccaagtcaagattaacattactttctttcatacatttgtataatttgatgtgcttcgtgctctgaaagcagaccgcccccattaaaacgcctaactatttttcgttttgctttactgagtggagacaagccatgttttttgaacaaatttgcgatatattgtttttgttttggtgtaatgaaatggggactatatactcggtcatcttgtcgtaaataagcttgtaggttagcttttaactgttcaccttgtcttactgccatatgaagatgcatattttctttatagacttctttcatatgatctacttgccttttcaaattttcattttcttcccttaattgtgattccctcatctttatttcccctcctttatatcatctgaagaacattttactttttattcagtttaataatgcttgacaaacccacttgtctaccccatcataaatttcgacttcgcagtgttgccctttttcatatttccaaattccttgatattcatcattaagtacgtcgaattctttagtttcttcatcaattaattgcgattctactagctcacacatatagctccaaactggacaacgaccgcttctaaagttttgtttctgtcataaacaactcggatatctttcactttataacagctccttttcattaaaaactcaattagatcctatttttaatcccaattaaaatgtttgggcctagcgacaaattcgtaattctcctcccaatcaaattgttttaacccatcttcttcaaattcccagcaatcaccgagtaaaggatcgtcaaattcaggaactctttttttaaatgttcgaagtttgttgaaatggctagctgttttaaatttaactttatccattggtgcaaatttcatcttcccatcaacctttctctttaaaattttacttttatcttgaattcatctggattccattaccacagtttctttttcaaaatcatttctcaacttgataatggaggttgactttagatatcctctgtcctttgtcttagcccatgcaaaaaatctattatgcaaaggagtgtaaaggcttcctgtattaaccgtatgctcatgtttgttgctgatcttatgctttaatcccctcatttgtttccaaaagttatagtaagggagcttaagttttgtcatgaagccggcatcatcttcaattacataaccctcttcctcaattgaaaagtcttgtgacacgtccagataccatctatagaaatctgtccagttactaaactctgcaacttgatttttgcactcaatggaaagactctctgcaactgccttcacttcactataagggagtttttcatacgtcatttgcctttttacgatgtctaataggactagtttgtctttactgtattcaatgatatgcggatctttttctggaagtgttacttcaaaaacgaatgaaacattatttagcttcagataatctttaatgatatttactttaaattcatcaaaggacttgaaaaacatatcttcaacccattttgcatgttcacttgttaattgagacgtaaaggatttagaagtgaataccaactgatctgacaaagagtcataccctacagttcctaaatatccattcgccttatcgaagactgttactggaaacttcattgtatccacgagatgatgcattcttgtttcagaccgttccccaatgttaaagaacttatcatagcttctgcttacaatttcattgctctcagtattaataaacaatccccttgccttaatatttgtttcatcccactttttctttctaaatgcttgctttgtaaaattaaatgaagagatattgtttggcatcttattctcttgcacatattcatgaccacgtaagtgtgaaatcaattcatcaattgttccaacagttgcactgttactctgtacttcacttgaaatttgtttaaagactttattcttcacttcatgcgtttcaattccgttctcagacagtgtaacgactctaagatgacctcctctttccacttgcccttctaagttatatgatctttctgctgctaacacaggcagacggtacatgtttctatgtccatgaatctgtacaacattttgacctgcagtattatttgcaaattcataatcaatatcgtctgaataatctccaactccattgatgaattgtgttgttgcggtcatcaagagattttcaggtacggttgaaactcctccatgagttacaatgtatgtagtgtttttatatgtaaagtaagctaactgatgaaacttcctggccaactgtctaatgtcttttttatcaatgttggattgttcgatttcaggtttagttttgttgttaaatgtggtgctaggtgtttcttcatcattcccatacatattgatatatctatcgtgatttccttccagaataatcacatttttataatctttaattttgatcatgaattctaacagctgtgcattttcaatacctctgtcgataagatctcctacaaagatgtatagttcattttcatttaaatcaccgtttaagtactcttgaagcacagtattgcagccatgaatatctccaaaaatatggatctttttataatcgtcaaaacatcttggcttataagtcatcgtgttttcgaactcatctggttttagaacagttacccaagatggcactttttctgttgtcattctttcataaatatttagaatactactctcaggaacatgtttatgttcagccctcattttatttctttttaagattctccgaacatcaacatcagaaaaatcaactacatgtacacggtatctatatttttgagctagtggcttatatcttgaaatcatactttgttttgaatgagttgcatcgacaattgtgaattcgccgcgatccatcctgtcttcaagcaatttcattaataaatcccacactttgttatcgtgtttcggagagatttcatattttccacttttgtttaacacaggtgactgaaacagtagcctaatgttgtccgcagaaagtgtgtattgctcaagtccattatctttgatccaagttgatttccccactcctgggcagcctcttaataacactaatgttctcaaattctatcaacctttctgatttttatttgtttaaaatgcatcttttaatcacttctttgcagcatagctctcaaagaattcttcaactgatcttagctaacggtttttatttggatcttctggatctctaaatcttttcgatagtaccaatgaccaattaaacatcaatggagaaaatctcgcccatttgctaaagcttaactgaagacctttccattctctccctgctaattccgctaactctagaatttgatcttcttttaaatttacttcttcttcaaacattacttgaatttcctcatatggtttatgtccaaaacaacagtggcgtgttttcaatccaatcatgaaattcaaaatatcaattaaattgatcatttgtgtatcaagttcatcatagggaatgccatttgtaatgaatttttctctttgtcctgctttcacactattccttaataacagggtagacctcttactcattccgcgccctcctcagtccaaaacaatctctcattcgttattttttccaccttataatttatgaggtagttattttttgcgtattcctctgcgtattccaatgcagttttatcatcattggcgccgaaactgagatgcttccatccgtacttaacttcgtaccacagcttatattcaacacgctttacttcagcattcactccgcgccctccaataactcaggattttgataaatgtctccgatgacttcgatttcacttagggatacgtccattctccaaaagtcttgatcgtctcccctattgaatacaaacgacccaagagaatctctaaacttgaccactgcttttataatcttgttttcgcaatagacagatttaaactttatgacgtccttctcgtaaatcattttttcgtttttatccttcaaccctgtgccccacatgagagccgcgtttctattcgtgctgtctacaacgggaaccaaaacatctgtgtataaacgtttcaaagtccaatcaccgttatttttgatggtaaggctcaacccttcatcatcccaataatgcatctgctcgccgtcccacaccctgtatgctgtgttcacaattcccgcgcctcctttgggttttcgtcacacatttcttttaacgcctccacaaactctttttcgctcatgttcagcggtgtgtaccactttataacttcgtgaaacggccggagataatttgcaagtgtatcttcagcatcttcccttccttttgttgtcccagtaaaattatttaaatagtcttcacgcgtcatatttatgtgcgttggacagtctaccactgaactaaatcggcagtaccgtccattcggttgcttagcgattaatgcacccatgttattcccccttatcttaatctctataaaacttaaattttatttttactcttaatacattcatgctgattcacaacatcacggagtatgtattgtatttcctctaaattgtctttaacaaaatctaggtctccaattgccattcttatttcgttattctctatgctgcgcaatgacctttcacatgacgctaagagctttgcatatttctttaaaaccatggttcttatttgattattagttggttcattaatcaataattaaagctatctcctttcctaattctaattcgattatataacctcaaccatatgttgtaaatacttattttatttttattctaaataattttaaaaaaatcagctttactcatactgtaaagctgctgtcttcataaacgtcttcatgccgtccagtttccaaagagtttcatttattttgtctctaaattctaaaactgaagcatgatccattctaatcctcaaacaatccccattgtttttaaagataatgtctatgtagtactctccactttgtatgttcttagaaccaacactcatggaaactgatctcataatgtctttcaagtcaatttcaagattaaaatccattgtatgctccagtctgactaaaaagtcaccaattttttatgtctcatgatgactgacaagatgtgtatgtgcttttattttattgataacagttgagaagatttatagccttcattttcaaacgaatcgtctatttcttcggcataagaggttgttatttcagcatcctctgtacacatgatgtctacatcaaatagtgcctcatatttttcttgatctttttgaagaaaccccattttccctgttttgtttcttaatttctttttaattgattgatatgcgaacaagagtgcttcctcttcattcttggcttttatcctgccaaaaaaaggaatgcacagctccccttgaataaaataatccttttctgacatacgtttccctctctctggtagtaattaaccgaacttatgttccctttttgttgacttaattataaccttttacctagttagtggcaaatcttttttctttcatttaaaaacttggaaagaattgatatagtatgataagcaatactataacaggaggttgtccgatgcttgaggttgaaatcggacaatgtttgatttccattctcctcgaaagtaaaggaatgtcattaggagaactttcaaagcgaacaggcattagtacgcaaagattaagtgactatgcaaacggctttagaccttctatgaatataaaaacagcgaaaatcattgctattgcccttaactgttcaattgaagatctctatgaatggaaaatcaaacattgactttatcgctagggagtttggcctagcgaacctccttgtaccctttttagggtatagaactattttactgcatatgtacaaatttgtctctgtctaactttgtcgaattctgaaaaatgtgaacaaaatcctgatatttttcgaaaaaatatcacgagtttatccgcacatgttttatttttactctaaaagttatgtaaagataatccctgcaacagggattaagaattagtctcaattacttcagacttgatacaatatttttctaagttatccatattcactactttcctcagtgattgtgaattaaactccgcgtcttcattcagaaacccgtattgtcgagttatttttttataatcaggtacttttaattcacccttctctttgtatatctcatacgccatgttgagctttcctgagttgataaggttcttaggtgaaaagaagggttcttctaaaaatttttgaaactggctaaaagatcggtgaactaaaaacttgtcagctttcatactctgattagaactcttgtattttagcctaaaaatgtttttgcttttaactaatgtagcaaatttgtttttaagaccactatctggcgaaccattgctaagatgataagttgtttgatcattagcacgcttaagcaactcataacatttatcgcttacagtaattattcttacaccgtgtttatcatctatcagctttaccttgttatcatcaagtaaatcgtcacctgttaaattcagtaactctgaatgctgatagccatctatgccttcataaatagcctgtatcatcgctttatcctgatcattaaccataaaatcaacatactcttctacttctttattggtgaatagtgtttttttgtttttatctataaactgctttaagtcaccatcctgtatctgatacactttgttgatgttactgtttgccaagccattttccattgcccaggttgtgtattgtccaattacagctcttgctcctcttagtgaatctatagatttgctatctaaatctaaaaataacgtacgcagctcttccaaagaaaaattaaatatgtctttttgaagtattttttctgtagctgagaaatcccttagccttagccaataatggtttcttgttgcttcactttcgtatttctctaaaaacttttccttcaattcagcattatatatttcactcatattaaattctcctttaggctttaaacaacagcaatttcatcataaaacattcgcttaagtttcttcttcataatattctttagttgattctcattattttgtcttcctaattcttcaaacactcttccgcttttactaaagtcaatcgtattaaggatattttcaagcttgtttagttctacattgttttccttcatcttcttggccaaataaacataaccgtaaaacattacgttatgattaatgtatgattgctttctaatggacgataaatcatcttcaagaaattcgtctgggaatgcataaaaaaggttatcaaaaaagtctaccaagtatttcgcaattttcaacgcatcttttcgagatttcaactcaaatacatcgtctatagcttcggataaagtataatatgttacaagaaaattgctatcaatagcaatttcactttgtgggcttattttatttttaagttcacttttaaatttcagctgctcgacaacggttgaagaataccgtttttgacccaattcttcaattctggatttttcaactgggttaattgtattcatttgagcaaagtgaaccttagccttttcttcatcgtaattgagcacatttaaaatgaatggttgatctaattcagggacttcagcaatggccttaacaatacctgaaattcgatgatatccatcaagagcatctaataaggttcctcgtgttacagtgagggtttggtcgcttgaatcatattcaacttcttcatcaccatcagatgttccaagacgagcgttaaaagttaacattgatacaattaaatcgcctttaataaacaattctttgatctcatcaactgatttagggtttgttttaggtacaggaataaggctgcccttaatgtactttccttctcgctgagtgttgtaattgtactgcaggatggagctattatataactcactcagttctttggcagtaatggaagtgacatagttatcctctttaattttaatcacatttttaaacttgtaggggagcttaactacttcttcaccggcgaatactctcccaccttcaagctcttttgccaatctggttggaaaataatttgacggatctaaagcttgcgtcccaagaattgaatacaactcttttgaaacaatgtacacttctttttcgtttaaacgctgtacgttgttatcattattatttaaaatttcttggatataaccagggagtgccttgtatttgtccgccattgtggcttttaattccttcaccatattgggatcatttttaatatcattaagatttttctctatttcagtttttaacttataaagtttatccgttgtcaacaaaacttcagacacattatcacctcacataatcatattaaatttatcattattttcataagcaagtaaagcttttatatgattatttgtatcacttgttcaaaaacattttaagtttattctgtatatacatgtctgattttaaaaagaattctttatattgctctaaggtaacatcatctaaaaaggacatgtcttctttttgatcaaccaaaacccctggatcttgagaataatccctttcattgactaaataatggtcatttaaagtattgatattgctgtggccagagaacgctgccacttttttaatatcaccattaatgctgtaagaaaagtttgttgcagtattgcgtaaactatgcggagttatctttctttctttgggaatgcccataactctacatacgcgattccacatatcctgtattgaatcaactgttaacttatgaaataaaagctcatgttccccatactcttgctttaacagcaataactcttcataaaaagcagtggaaatcccaactggtctagcctttttttgcttagtttttttaaagttgacgagatagcattggtgcttttctgaataagtaatatcatcccacccaactctaagtacctctgatttacgtccaccagtacgtgcactaaacaaaataaacatctttttcattaatctgttctgacgctcagtaacatacgctgcctcagcaaattcatcagcttcagatattccttcaaaagagcctgctgggttcttttctgttggaagaggtctaaaattaaatacagatgcatcacactcatgttcagattcaaggtacttaatcatacttttcagtgcggcaatcttattgttaattgttgaattggagttgcttttatttttagccaaatgggttcgataatcatacaggtcactcttcttaatcgccaggtcactctcagttaaatattcaatatccttggcagcatagtggttgaaaaactctcttatatgcctttcatacgtggctctagtattagacttttcaatttctccagtttctcgatccctgtttcttaaatctaattcatcaaaccacctatttatgttattgtatattgaataatcccttagtgttgacgctttcttttgagcttccataatgacacctcatatcatttttttcattaagtattgatcaaattctttccacgcaacaatccattcattctcaccttgaatattactcagcagcattatattggcgttacagatttccatttgctttaacatgtcgtattctttaagagcgttaattaagatgtctgcattcattttatcacacctaatttatttttatcctataataaaattcagtttaggacatttaccctctcgtccttacagacgtttataattggcatccccgtcaattcctcataaagctcctcttcgaacccaacccattcatcacttgtcgcttctcttcgtaggaactcattataagctactgctatctcaggctgctctagaaactttaaaacgatcatatgctttttccaaactttagccttgttttcttctgtataatatttattattcattttatttttactccttaaatacattttatagaatttttttgttctttaatgaggttgtattctttatgattttttctcattgtagttacattattaggtgtaaacacatctggatcctctaggtggagattgactcgtgtgaagttctttagttgttttatgtattgatattgtcttaatgatgtaatcttcaactcttccttttgagtggcactggttgtttccattgtttcatctcccaacaacgttcatcttgtaacttcattatatatgttgctagaataatatgcaacaatttattttatttttattcaagacaaataacacatcccctatgtatgtgttaaaatgtctgctgatttgtctttaatcttcattaggatacctttgctttatattttgatctaaccatttctgcttcattttcaagatgattatcttcctgggaaatttctaaattaatatctcccatttccatgtaccccttagccatatcctcataagaaagtacttgtccgaaatgctttttcattttaattcccccatgttcttgttttttatattatgaatttctggaacattctcttaaaattagaaaagacgcctgatccagtggatcaaacgtctagccaagttatgtattatctttgaagttaagccccgcggcttggtgatgcaacttttacaggctggtctacatggtctaccgatgctgtctcaattgattgctgtccggcaacaaatccaacagccattgctaacaagattactattccaagaataatatttttcatttaattcaccccccttcaattttagaccatgattaattcaagtagtttttcgtcacagcccattttccttagctccgctaatggaagattgataaataatttatcaccagattttttcaactttgcagtgctttcataaaaataattcttattttggtatagaatccccttaatgtaatctagaatcccagaatcatattcgtacaattccatattctcaagctcatttattactttctctgctttattaaattccttattattagtatagtaatatgctacctcaatcttatcagggatattatcagtgtcgaagtcaagccatttattatccttattccataggttgcttaaaaagcaaagagctaatcgcagcttatatttatgatgttcattatcacgagcaaattccaatcctttaagatactgctctttggctttagagtagctttcaaaaattaatgtgttcccatatgttagatgcccaaatacttttagtcgatttatatttgaattttgaataacttgttctgaataatacctagatttttcaatttcattatcatttaaataaatatttgcatttaataatgaaattctattcatatagcaatctttcacaaagccttcgggtaagtcgttgaaattgagaagtgataatgtgcttttcatcaatccaaattcgcctaccttcaaatactcatacatcagcatagcatttgagaaaaataacatttcatctgttttgcactttccggttgctcttattgcatcagttaaacttatcttactttcgctcaatcttctatgtatactgtatatattgccccattcttgacttgctaggttttttgagctagatagcctcgacactatcttgtctgttaacgtatcccattgattaatatctgagtattcaacagattgtctggcacattttttgttgggatccagtgataagaagtaatcacttagaagctgctcctcattatcaggaaacaagcttttaacaatattaattaaaccgcctaagttgtccatttctttctctggggtgttgatgaatttgtaaaaaccattaacctttttgtaccctgctatttttgagagtttcgctgcgagctggttgtctttttcacattcattcttaatcatctgcttaagattcattggttactacaccccttcccaactaatgttccctttgtttataatatacattagagttgtcagaattacaagtatttattttatttttattctaattattttttaaggaacccttatctgtttaaaattcgtattttatatgaaccggcacaataagaatccttactgtgccttaaagatatttagtcctagtttatcttttaatgcatcctgcagcacctgggaaaaattaatgttcttttcttcagccacttcatttaaccaagccggaatagttaatgttttcttaattgatttacgcctatactcatcacgaaatgcatgcataggcacatcaatcaaacacacaacttcgttttcccctgtcttaatttccgaaaacggtgagggactaggatacttctctccgtccatttccaacccgtataaatgaagacctaaagcttctttagccatgctaattgcttctgtatcattttctccacaagttatacaaccaggaaggtctgggaaggttactgtaataccatcattagcatagtgtaaaattgaggggtaagatacccaattcatttaaatcaactccttaaagaagattataaatacatttaaaaagtttgcaaattcaatacgtataattgaacgtagtatgtaaaccataaaaacaatataaagttttattcattaatttcaaaggagcaaaactttaatgcttctggtacataaagatcattaattggtctgtttattaaagaattatcgtttttcctccaaagaaatctaaactcttcttgttcagaatgcttactatctttaataaggcctggcaccaaataaaaatcagtgttttcctcattaaaagtaatgctccttgaatctctatatatgcaattattcgcagcatataaggcacaatttctttttttcattttattgtgtacccaatatgcgaaacttggaaaatcattaattaccattactgaacctccaaactttctcataatatttttatcataattgaaagttaaacaataaacataaaaatttttatttattattgaggtttgaaatgacacatcttcaagtctaactattgagtcaggaaaccattcttgtagttcattgtgaaggtgtggattatggtctcctgttttatattttttaatgtttaaatgtctgtttgctacaccttcttggtcatctccaacatccgcacctaagcttgactctggatagttattaaggtgatttacaaaaagtttcttgtccctcattaattttttcaaccatttcgcttccatgtatttataagctttctttggaaaatcttcaattggcatatatctcatcttacttctgctgtccaaaaaaatgccccctagtaacttttcaggttcttatgtctcatcagttgtatttttatttctgtcaacacttttaaagccgcttccattcaacatactcaaaccgctgctgataaaggtcttccaggattgtggcccattcaacccagccgtccacaacaatacttttcttctccccatcctcaatccattcaatccagtacacctgaacaccccatcacctagtaataacttcgatttgtctaatggcagaagtgacattaaactctgtacgcagctcgtttgctatcattaaagcttctgacattgtaatgaacttagaagcgccatgaagtcccttagatgtcttataaccacttccatctaatttaaatgacttgaagtaatcatcattttcaaattgaataacaaaaaaggtatcgataacaggcatagctaactcctcttcagcagaccagcaatttttatggccagtggcagcaatccaattaatatgtaaaacaccatgatatttattttattcttaaagaacagttcaatcatattctgctccatacctggtgaaaatgaatcaatcagttcctgcttaaactcttcatcataaacctgatcaacaaataaggccttaaatcctgtcagaaagcctacaccaagccagagcattaagaaatatgctattccaatcaaattaaaaccctccttatatacatcgtctggtattatagtagtgttaaatactttgtgtaggtgaaatttaatggaagagaaagattttgagactaatggctacgatgtaacagttgtatatgattataaggagtatcccgatgttaaatatggtcgctgtgacaactgtgattacgctttattcaagagttcagtgaaaagtggtgtgtttttacgtgagtgtcgtagatgtggtatgaagaagagcatttagtttaatgctcttttctatttcactggaatcatgtagcttacataaacttcaattccatcttcagttttatattctgcaatcctgtctggatcagtttcaatcttctctattagtcgtttcgcatccttgttcctctttgcaatattggtaactacaatccaagaccaataatcccattcagagatgcaagatttaatcttttttggtatcttatgacctcttgtataaaccttgatcatttacattctcctcacttaattataatttttacgtgctgttttacattaatgatggtattcttcggcacctgtagaagttaagataacagagtaagttgtttttccgatcattggatcattggttctttttattgcctccgaataaatctctaaaagtctttcatttgcatgataggcatgacggtttgacatttctgttgaaataaaattaacagtttcgcttataagcatgtcttcgtgatcaggggagttagaattaattttaatacttgaatcgatttctaatccaaggtaattatcatctgatgaaaaccccaacaattgtggtctttcgtctggtttaatatatccaacaaaaaatacggaaagtgggttaataccagaataatatgcttcaaaacatgattttccgtaattaaaagcttctctaaaaaataagagtggatcaatattactgttcaaaatatcgcttttttgatcaataaaatcaaaagctttttctgcaataaacattctacctgcaaaagaaattacgtacttcttattaataatttttattttcttatattcatctgattccacttttaaaattcggcccaagctatttgtagtagtcactcttttgtcagcagtcattactatgctattgtcgaatttaactgctattagcatcgtcatttgatatctaacccttcaaaaaagtattcctgactcaacctgacttacataactggttaaaagactggtttcatttcaacttaatcaatccttgaaaacagctcgttcattactctgttaggatcaataccattactatctagattcttacttagctgctccaataataggacaatctcttctcgattaaatttaaattcttccttgtctaagtctagtaacagttctaatgacttcataactttaacaatttggactggtgaaagatttagttcgacttcctgttccctgtcgattgcaactggaacagataataaagaagaagggacttttaagattctgcttccgaaaagaattctaaccatttgaccgttcaattcgtaatacttgtcttctagtcttccttgagaacctttttttcttatcaaggaagctttttctgacgacccattatagtaattatcatgcagcagaactgcagtaccggcagtcaagctttgtttttcttcttcagaaagttcgcttattttaacccattctttatctctagccaattaaaacccaccttaattatatttttcaatgattcttgaagcagcgtcattaaaagctgtttctggacactcagaattaaaaatatttaacaacttttcttcagtgaattcccttttcatatccgcgatcatttggttttcacagtcataagaattaaaacttaaatgggctaaatcactgagcgaagatgattctccttctgggattggccattcgatttgctggggatcatacatataaaaaccaccgatgtatttaaagctttgggatttatccatcctttgaattgtcgagtcgtctaaattcagctctgatatgaatctatacattatgtactctcctttattaattaagatgaaagaatgattttattcattaacaccattttcatattcaaggttgtatgttgctatttcgtgtactcctatatcccctgcaaagtttccatcctcatattcctgttgcaaataaaccgctttatctttttcgaagatttctcttgcttcaactaattcagttacagcttgtgaccctagtcgatctgttacagtaaaaactaagcaccgttttaactcggtaccgtctttaaggactacgtctgctatgacgtacccatttggctttagttcgccaatttcattgcgtcttttatcaattgcctcttgaagaaccacagaaacagtattgttatcggacttacttaaagccatttctaattcttcaatttcttcaagtaacacttgaatttcctctctcattttatctctccctttgttgtaaagtgcaaatttatgctactcctcaaagtgtctcgcaattattccactttcaacaagattacttttttatttccaaactctgtcaattcaatatttttttgaagaccctgatccaataagaagtgatacattttttctgtttgattatcctttttttcgtttggcattccccggaaagtcatattaccgcatgtataatagaggcagtaaccgtcgtcaaacatcttctcaaaagtgaaacccgctgaaatattgcttagtccttttactctgcttttagagctctcagattttttaaagctaccttttaataaaattcgctgaacttttgcttttaaagaagttggcaacatttcttttcctcttttccctatgaaagtacgattttatgtagacctataaaatttgtaagtatttactgttcttgtaactttagtataccatgatcactttaagtgatcaatatctttttaatcttttttgtaaatcaacagctcatgcagctcaatgtctaaatatgtacagactttatccaacagatcccttgggtaccgctccatttcatcatgatacagcttcctgactgtgttaaaaccatgatcaatatcattggacagctttcgaatactgatattcctttcgtctaatattggctttaaatttgatttaatcaatgttactacctcgcattcattatgtatgatcactttaaattatcattatatccataaaaaaggtcaaggatataccttgactatgtatcaagcttaccaatcaaatgaatcttcatgttcaaatccataaatacctttaatccacacatctccgcagcctggattctttgtaatctctaacacatgattacgattagcatctccctctactcgatctgtagcagtatagtcagcatagttccctacaaactgcttctcactacgtggaaatacccagccagcaagagttatcctactgattttcatatttagagtacacccttcagcattgttaattgtgaatttgtagaagagccaagtgcgatcaaaattccgatcaaaataatctgccattgaaaaactctctgaatcctcactcatgtgaaaatccacatttttgtagtctaatgtaagcttcgcctcagcacttggtgtgttaaaactcaatataaaaccaatgcaaatcacagccaaaaagattagctttttcattccctctcccccttttccaaattatactatattggaaataaaggtgaaagaacaggcagaggcttcttaatttatctgcattctccttgatatagctagatatacatgtatctatgaatatctacgtgtatttataagtatctatacctccctacatcacacaaatataccttattaagaacaaaaatatttattttagttcatttttaagaacaaatcttccatttttatgatataatcatcactgcttataggcagccttactgcttattcgccatatggtataggaaagaggttcttttaatgaacgtaaaacattctaactgtttctttgttatcaggctgtttgctgctctttgtgtgttgattggtcatgctacaagagatctaaatatttctgtctttggttataccccagagagcaaagcaatatttcacaccggcatatcaatcttcttttttctaagtgcattttttctttttacttcttatgagagatctcagcttaaaggtaataatgtaaccgatttttattggagccgaattattaggatcgcacccgctatatacacctatgctatcgtctccaccatcctgttaattgttctaggagctctttcattaacagtattcactactaaagagtactggacatggcttcttagcaattttgtgttataccctcaatacttccctgacatattccatcacatcggcacaggtcgccttaacgattcactttggacaattcctgttcagattagcttttacctggtgttacccgcaatttattggttttataaacgtttcggattcccaaaaatgattctttgctcttttgctgtttccgctttcagtgtgttagtctctttcataattttaaagttcgcgcctggcagtgtgttcggtaacctgtacttacattctttcctgccgcagatgttttatttcactttgggcatcttctgggctaaggcatggagcaagttaccgcagcatatcgttttatttttgtcttcggtaattttatttttattctataaacttgaccttctgcatctcagttcaataaacagcaccttatggagctttttatggttcgtacctctgagctatgcactcgtctggtttggttacaatgggccgaagatattgcgacagctgaaccggttagacgatataagtatggggattttcatatggcacatggtgatcatcaacatcttcttatacactggaattaataaaacattgtctgattacccgctgatcatagccctaattgctgttactgctgcatccgcatttctttcgtacagaatagtggaaaaacccgctcttaaattacgtaatatcaagaaaaacaaaccagtcaaaacaaggattgcgagctaactgcaagggctgttcttatgtaggcagcccgattcccgttttaaaataaagtagtgtttttgttcaccaattccattctccattaggctctcctgttggcttatacataagctcaatatcaacaaatgttttatgattacccttaggaaatctaaccaggacaatctcacccttttcaggaacaaactttacatcgttcctccaaaatttgattgttttatctccttccttagtaattggtgttgtatgataaccatatttttcggcttgagtgctagagatcacgttgcctccataaacatattcacgttgtccattacgtgattgaatttccctagtttttaaatcatatgcgtaaatgtcatattccttattctcttctttgtttaaatatttgtcattaagtgcttcactttcttggcttgaatcattgtcataataactttttctttcattttcatcatcgtgatttacctctaattgagtatccacataaacttttgtattgttgttaaatttactacactgaactataagaaataccccgataatacccaaacataaaattattaactttttcatcacttctcctttagtttcttcgtcatccctcatgctgttgtacatattttaaagtaacttaaatgatttttttatcgatgcaatacatatcgaatccttgttttataattcttgcctttccattagctgtagaccaactttcacttaaattttcaataaaagaaaaaagtttgtgctctaattttccgggcgtaaccttcataacattgcgaaagattttcctatagcgaaaactttcttcaaactcaatcataaattcatttaattccttattccatgtatccaacttttgatcattgagactgtaggaagatcggttaaatgagtaaggcggatctatagaatagagtgctactggcatacctttgtaaaggatttctgaatagtattggctttttttaactccccagctaaggtcattctccttaaaatacctattaatctgtgattctaattctttaaatcttaagtatgatttatataaggaaggattctttcttgctctagttacctgagcataaattgttggagcttctgttatcttggcccaaattgtacggtgtgttccatcaccgtaaacagcataaaagtcatcatcttcataatgaaccaatttcactggtgagtgttgataataagtgtgaaattcttctagactttgtttttttaagtattcaaaagctttttcacatcggccaatgtcaatattatctgtaccgttataacacgcgtgatcaaaccaagacacaccactggttcccctgaatcctaaactcttaattttttttaacgggacatcccgatatagtttttcgctgtttccgacttcatcataatacaattcatatggatactcacttatatttttggtgtccttcatttccttaatatgaaattcacatacacccttttcaagaagcaatttttcaagtttatttttcaaatttctccccccaatgacgtctcaatatcattgacaactcatgccaataggtggattttacattttttctttgcgatgataaagaagcgtttcgaattaaatggtgtttttatttagacaggcattcctcttaataaaatatttatcttattatcttctattttcaactaaggttgcgatacttactttataatctactgacgaagcattcttgtggtttgcaacgtcgtcaatgtcagcaaacatacctccgcaactcaagtcattaatcaactcgatattaaccaacggatcacggaatgccttgattctatttttatacttataaacttcgttaacaccattttctgcccacatcactaagagcaataattctaattcacgcatataattcccctttcctattaaactgctgttttattcagatttattatagagtttataatcaccttcgccatcctcatgatgtacgtctttcgattcgcattttttacaaatataactacctttattgaagatattgtctatacctgaatctgaatagtctacatcataaatctttccgttcctagctccacctgttgtatcaataagctgtttggctcccaccgatacctctaggtagaaaaaacgttcattaccacaatcattacatttagccattactccgcatcctcctctgcatataaatcataataattttgtttaattaagtatctacttttccccataagatgactttcgctacaaacagtttcttttgttttcttgtcaagaacagccgtaaaccctgccctctgttttgtttttaggactctgctattggtatactttaaataccattttctaaataaatcatattcttctattgacacttctttcattactgccattacttcatcatctcctgtataaaattgttgttttatccacttctttgataatgtttgtttatatctttaagtacaatagctttaattttattttcatgctctttgtctacaaaaatccttatcacattatcacagtctatgtgttctaaatgctcaagctcttgctgtgtatcaatataaataatatcccctatacgtttattcccgtatttatcaaagaaatatttaactccctcgtcatattccctgtcccatctttccatcctaatttgatcaattggtgaattagaggtttcattcgtaaagtcagattgatcttcctcatttattttagttgcactcactttcatttgaactcgttcgttaatttcttgagaagtatcttctataataagatattgattaataataaaatctagtgcgttaattattttatttagataaactttttttacaggcttcttaaattgattgtaagtcaaaggtacttcaatgtaaccacgggcaagtgtatcgtactccgcaaaactatttgaattatcatcacgctgaattaccttatattcaatgcaaaggctattagtattacggtaaaggctggtttgaagcgttgtattgttatctaaattatataggtcgcatgttgtttccatacttcctctgaattgattgaaatctacttgatatgtactcatcttaatgtctccattctgtttaaaatatgcattttattttatttttacccttaaaatatgtatgctttcgctgttgttttaacttgatttaagtatatcatgactattttaaataatcaatacttattttatttttattcttaaagtgtgtattttgttatgatgtaagcaagagaagcttcgatgtatccagtatataataagaagcgttatttaccgtatcactgtaagattgtgccccctcaaaatcatttattacgtctttttcttctgccgtcatatcctgatattttaccttgccatacgaaggaggaagccagtttttcttttggctgccaaaaatattgaacttcttaagcatttccttgtctttaaactcaatgtgacatgtcccttttttatagaaagttacatagaagtactttaattctatttttttcgtttcaccgtaatgcttagccagttttagagattcatctatgtttatgtcttctgttaacccgttgtcaaggtaattgaaaactttttcgatatctttcaacttttctaagaccttgtagtctgttggactatagtgaccgagccaactacaatacccgtttagtggaataattatttttttattaattttatatgatttatttgttttccacccattatataagtgcacattttttgatgattcatcatagtaatgcttgtggctaaattcttcaaaaaggttaagtattgtatcttccacgccctgcgtcatctctttgctcatctgaattctcaatgtatagatattgaacaaagaaaagtcataatcttttaattcctcaacgtgctccaaatacttttgtttcagattgcttgtgaagagccccataaattgatcattgttaaataacgtattccaatacttcgccctaatttgttttatatatgcattctctatgtcattttcttcggtattcttatcaattagcagcttcaatattggagtactgtcatcattgaaactatgcagcattaagggtttcaaactgttgtattcattgattaattttaaacccgctttgatttcatagttgaattgttctacaattccttttataaagtccaccaactgtgttgctttataatcctcattaattctatgtgactcatcttttttcaattcttctattagaacgctgctatattcttgtttttcaatgcttatgtaaattattgctgtttcaacttctgtgtttcgctctgagttcgaaaaagcgttttgaatgtattcaacttctgcatttatttcctctagcttacgtataagaaatttcctgtcatttgaatacggattttttaatgtttcggcatttagtaagcaaacaatttggccggatctttgttgcttttcaattaattcaatcgcctttaataaatgtttaacaccgctgctaaaaggtggattcataaaaatcaaatcatacttcttgtaagtgttaaacgtcagaaaatcgtctgctatcactctataacttttcccctcaaggatgtgccttaagttttcatcttgttcaattgaatcaatatcatatttcgaattccctctatagttcttggtgtatttgaattgattgtgaatagcttctaccaaatcccctttacctgctgacggctctaaaacagacttaatatgcttccattctatttttgatgtcatttttcggattaactgtggtggtgtcggataaaaatccggattatctttaaacattttttgttctccctttttagggaatgagatgttttctcatcccctcttattttatagactaggtttatatgtgttgattagaggtttgaagcttttattatttaagtaatttagaacctcgtcaaattgtcttttgtcacacgagtagtacttactgtgaattattttagtcccatctggtttaacctctacattattcaacacagtttcgggcagcgagtgccaccctttgaacatcaataattctgaatagaagtgtcggtaatataaatttcttttattttcaggcttgtatgtcaacttcactgcattatcatattgagcatatttagttgactggcaactgtcatacgttattttttcagtaattaaagatccaagatcagatatgtaaaacagagtatatttttcacctttttcaagatcagcatttttaaattgttcttgaatgctgtcaacttcatggagaattctgtataaagaaattttcaattcctctgtatctgcttgttggataatttttttactcaaatttaaattattcaatttcaatttttctttgagtaaagctttatatttgtcccagtcttcattattccaggttgcaaatatatttaattcttcaatgactgagctagaaagatcttctatttttcccgcttgatattttaactcgtctaattctccttcttttatcgcttgtttatcaaaaattgacttttcaatttttgcattgtccactaaaccaacgtatcttgcataagaatggccttgagcgtctacaataaattgcaatttcccgccgtagtacactcctacgccatataaattccatttaactgtgttcttttctaaatcgtccatattgtaataatcaatcattgagttgatcctgttgtcttccgtaaaacttccaccggtttccgcaagaaaatcaaaatcatttaaaagcaagttagaaaagttgtttaaagcttcttcagtattgaaatgcacttcttttgtaattttcacattttcaagtctgtagtcacctttagcaacctcgtctttatattgatcaagtgcttgatttttgtttaagttggcaaactgtgcatcaataacaaaatactcttgatcttcattcagttgttttactacaatgctgctatagatattttcggcttgtttcttttcttcttgccgtctcttatattcagcatttttgatttcttgttcttttaaatattcctgaaattctttttcttttctcgctttctcggcttcttcgaattcttccatctttgaatcaaacagtgtcatatcttctttaatttcttctgtttgctctgtcactgtgtattcccaatctaatgaaacacgaccatagaaattgtagcttccagcatagtcagtgtaaggatctgctgggctgtagcaatggcgataattgtttaaaagactgttgcaataatcataaatcgcagtcaaataagctgagcctttttcataaggacttgatttgattgtgatgttaatagtgctatgtgaatagctacccccagtagtaacagagaatttgcattgtgggagacgttgtcttaaatgctttcttatttcctttgccatttcttttacttcttgttccttatttacttctaattcactccattgtgttgcatcccacagactcatatttacaccattagctttctttttggtttttgtgattgttttagaagatgagacttcttgtttagtaacaccattagcgacctgcattgatttttctgtccgtttgctccaccaacattttttgaatccagagtatcgaaaaccgtttgatttaagatgagttaaaacctcttgttctggtttactatcaaaatatagttcaattccatttaactcttcattaattcttaaaacagctgtcattttcaacctctccattctttataactattttatttttatcttaaatgtatgtaatcctttgacttgatttaattttaacatgatcacttaaaataatcaatagatattttatttttattctaaataaagaaaatcctattatcgaggttcagcttgctgaaacgagacggccgtaaaggcactttacggacgaatttattattttttatttaattatttttctggttctccttaagacttaggctctaaaaccgttgatatgactggcttattttttaagtttaagaggtttgtcctctttatcaggtatcgagccagtttgtgagcagcttcctcattcttagagaaggtatgtacaaagttatttcttctccatccctaatagctgacctccatacccattgcactaactcagacaatgcaaatgcgtcctggtctattgtaatactgtacttttctttaaaataattatacagaacagtattcgtatatctgtttattgtatatgctaagtgtttcttatgcttaaactcgtttgtagcacgtgcattacatgagacaaacccctttgtatacccattgccctttattctgttcttatggtctgaataagtcgtccacatagcttcatcacttgacgacttaacaatattattaaagtaattgaatacattgttcttcacctttttgatggtgtaaggtgatttatttttataccaattagaagacagtgaaaactccagttgtcctattgtgtttagatttccttcatatatttttattttgtttcttaactcttttttaaagctcctttcataatcaggacggtgatcaatgaagctatactgtccatccatgtaagctgaactgtacttttgatacttaatgttgttcagatcgtagtaatatttttgtatttgagcatcaaacatatatgtaagtatgtaaacttccttgaataactggaatacatcggctggaaagttccaaatcaatatattgtctttgaaatacattagattgttatttaacgccatatctcgaatgtcatcgtatcgtgtttcatagtcttttttttcttcattccatttgacaaaaccgttttcaatataaatcagattggaatcaaacagtgttgttagatcatgtttctttacctgtaattgttccactacttccatgacttcatctaatatcagtgtgtaattgcctgcaagtataagttcctttgtctcgtcgtttgcgtttttaaaaaggttatgagttgccacaatgtttttattttgtgataagagttcgtgaaaggattcaaacttatattgtgttttatcacctttcttctttactttaggttcgaaaaattgtttggactttatgcttttctttatgcgctcaacttcatttaaataaggtgtgatgaatataaaggtttcttctttaccagcagaattcattttgttaatcgctgcagatgttttaccgctccccataaccgaatcaattattttaattttattcataataagtgtagacttccccctttaatattaaaaataaaggaacggataaatgttttaccgctccttctcatgtatgaaattcaattgttgattctttcttcaagatcatgaatacgtctttcaagaccagagaatttcttatcattgtatcggtggtcactttctacattcgcggaaagatactgtataccctcaaggattcgtttcctatcccgctcacctctaataagcatcggctagagttttaaaatggatatttaaaagagtagtgagttaaggtgttcagctacttctgcctcttcccccttaaatacaattttttctctatcaatgatttctaattctgacatgttcacacgtctaactttatatccctcaattgtctcttcctcttctatttcaaaaattctatcttctgtaatcatattcttatcctcctatatacattgtatttttcctcttaacttgtaactttattatatcatgatcactttaaatgatcaatatctttttgatctttttttgtaaatcaatatccagaaaaccacaaactttatttatttaacctcttacgtaaagtaaaataaatgatccatgacaaaatgacaatgatacacgttactatgaagatagccgtaatcagcgactgtattccgctgctgaaataatctttgatgaacagaaacaacaagaataaaacaacaaatgttatgttcgtaaaccataatgagaatcgtttcatgtttacaatgtgcttgtccatgttataatatgggtagtgactaaaggggattaattcccctttagcgtgttatctgcgtatacgtttgcgttgtctcttgctacggaggcgcttgcgtgtacgctttttgcttttcttattcttcatcaggttttgaatcttctcagctatcgttaaacagttgatgattaaaaccgtgataggaataaggaaagcaattgttatacccactttctcaagcactatgtacacctcctttcctataactctattatagcacatttccctttcaaagtcattttatttttactcttaaaatggatttttttaaattattttggcactattattcatggctatttataggctgtataaggcgtgtatgtggattggataccaatgatactatgattaaattaaaattgattctaggtggattagaatgcttctgatgatgtgtgcttagtgtgtataggatggatatatgatgtatggtgaaggaaacggatagagatgattaggtaagctgaggatagtttatggtggatgcaatgtaatgaggatgggaaaagatgaacattaaggatgaatataaaataggtgtgtagttagatgaggaattgtatagataacacttcgatttgtttcctttcgttatatacacgattattttaatgaatgggtattcacttttaagttgaccgcttaattattttttcaaaaatatatattgtttttcatttgaaattgtgttagctgtgcaaatttatcacctaaatcataaaaaccctacataacgtatcttatatagggaattaaataccaatatatagggggtatattaacatctaaaggccaaaaaataggaacaaatgtacccctagcacttccatttccacaccaaacttattttttcactttcccatttttcagcctattttcacatcgtaatcgctatcgtaaaagcctataatatcaatgtttttccaccccttattctcccctttttcatcagatttttaaataaacaaccacttttcctctctcctgtctacgttttacgatcacaaaacacctattatcccctttgacagccctaaaacattgctatatcaactaaataaccctttctgatcttcatttacgataagcacttttatagctaacgatcacccgggggtcattaaaaatcaaaataaaaaagccaccataataggcagcttccctttaaaattaacgttttagtctcttcagtgcctccatatacgaggtctttttcgattccttgttctccagcttcctcggcttgaataaatcctctctacggcgattcttcgctttatagacagttgtttctttaacttcagtgtttccactttcaattagatcatctaactgcttcatccgctcattgatccaggttaatccactaaggatggttattgccctattccctttatcataatgtcctttaaataagtctaggggcatcttgttatcaaagacattaaacagctcattatacgatatatgctccgttaaaaactcatgaacatccagaatgacaccagctctcatcacatttgtaaactcaacaggagtaaatatcgaattgttccacgacttctgtatatcttcatgcagcttatcaaaatacttaccctcaattgtaaattcattgaggtctgtttgagcaatagtcatgattcctggtgtgtcaaaaagctgatttaaatccttcctgtctaatgtactgatctttgatcctctgtccgtgtaattgagtaagacttcgattaaatcaaggaacatcttgtttgtctccttgtatagtctgctttcagaaatcttcccttcatatttgctcaaaaccatttgattatccaaaggtaagacacaggtctctggcatagataagtcatcaagtaactccagtgtattcatctggttaaccaatacctcattattgtcaggaaggattggtacagcaactattgttttatgtgtaagacattcgtttaacaattctaataatataggggctactcctgaaccggttccaccagctgcagagaaaactacgaaaataacttgtactgaaggcttttccattgtgttctttatgaactcaatagaggactcccagttatttttcatatgtttcgctgctacgcttctgtctttacctactccttctgtccctaccagatgaagcttatcttgaatattgattaatgaattaaggtctgaaagtgaataatttattgcaacagaatgaaatcctctcttcattgcttcatccgctatacttccaccggcctgaccaactccaataaatccaaacattaaaccctctccctttttaattgatatctcaaagcttcttgaccatattgagtaataaaaattgtatgctctttactgtttttcactataataataaactgcaaggcctcaagacgatcaatgctctttctaaaagtagcatcagttagttgagttttagcttgaatggttttcttcctaattgatttaaactttaaatcagccccttcatcgctcaataagcctagaatatacagatcatttcgagttaagttgtcaatgacagaagcaaaataagtatccatgtgacccctccttaatatctgatgattctgaagtatcttggttgatatacgattattatattgtctatttgcatttaaatgcaaatatttttgtatcttaatgcaaataatcatactctgcttgtatgtaaaccagtcattttataaaatttattcaaacagcaaaaggatgatttaaatggaatatagggttaaaagtaagttggattcatttctaaacagcaaaggtattgaaaaaggctggttagcagagcaaataaaagctgaaagagcaagtatatctagatggtgtaaaaatgacagcgagggatttgcaaccgtcctccctagtacatacaatcttttattgatggcacatattctaaattgtaaagttgacgatctttttgaattaatcgaaattaaatccaattaactttggatttttatgtttacaagagtaaaaataaaatatataataaagacacaaccacatgaagtggtctttattttaatcattttaagagtaaaaataaaatagtatggaggtgtaagatgaaaaagcagtatttatttagtcatttaatggggtttattgagggaaaagtagtcgatggtacagcaacacccgaagaagaatacctttatcaggattacaaatggtacggaaagattaataagcaaagctttacatatcgaagtttagtaaatcaatatcttaatagcgaatattaagcacatttaaagtaaaaataaaatagtaaggagaggattgattgaaaagaaaaaaagacggattgtctaagcaagttcacatatacagcgtggacacatcagcattttataatgacaaagaaaattcattacataataagattttgaagtcttatagatacagagattatcttaagacattagacaatgtaaataataaacataagaaatacatttcacaaagaattacataccttaaagaatgcctctattctgcattcgaagaacataatgacataagaacacttcgaactgacagcttaagggacaataaagtgatttctttatttgattcagtgttgacccgaacattagggattaaagaaaacaccctttcagaggaaatcatggttgtccagacttaccattttgaagtattgaaggacattattgatcagggatttttacataacaatgaaaaatacgtttatttcacgagcagtgccggtcaaattcgtacaaagaagtcatgtttcattaaaaaaagcacctacgataagtatcaggatgctttgacatgcggcttgagtattgaaaagattaactcccttggtggtagcagcattaacaaatggaatagctatatggccttatctaacagtgccagtagcccttgggagattgatattgataaagccattgttgtcgacgacttagaaactgatgtgtcgagtctcgttgactatattgatcgagatacctacgagatcacacgaaaaacaatgaacattcccattgagcatacggatggctgcggaatgattctccccactctgagtagcaaaagcttcatggtcagactcccatgggtaaagggtttattagtcccgtttgattttcgcaaatttgctgaggaaaacaaagcttttaaagtaactgatatatacggcaaggaatgggacgtagtgaaagatgatgttcaaattatcttcactaaaagccagtttaaaatgtggaagtattattcatcgtgggaagaatatcaaggcaattataaaaaatatggatgcttaggggcaaaactcaacgaagaagatccttctgttgaagggaagctcacttatcaaatgctccaaacacttacagatatctccggtgaagaattaattcaaatgagctcaaagactgtaaaagagattaccacattgggaactgacaaagaaaccatgttaagagttcttggagctacggagaaaaagaaacatcggacagctcttcaggacgctttacttctatatccagaacttcttaacgatgatcacacgaaagaaattattaaaaataaaaagaaaagcatgattaaagatgccaaatcaggaaaattgcttgttgatggtgctcgttatacatacttatgccctgatctatatgctttctgcgaaaaattatttctgaatatccagaatccaaaaggactgctttcaggaaatgatgtccattgttctttatatgatgaagggtatattgacatcctccgctcccctcacctattcagagagcatggtgttaggtggaacaaaaaagatgagaaatatgaaaagtggttcattaccccaggtgtttacacaagcattcatgatccgatatctaagttgctgcagtttgataatgacggggataaggccttaattatttctgatgagttaatcgtcaatattgccaagcgtaatatggaaaacatcgttccgttgtattatgaaatgtctgtagcccagaaacaaaagattaatagcaggaacatctatgaagcactaactcttgcttatgggatcaatatcggggagtacagcaacaacatcactaagatatggaacagcgacaatataaatctggatgtgatcaaatggttatgcatggaaaataactttactattgattttgcaaaaaccttattcatgccgacccgtcctgatcatgttgatgaaaaaattaaagattacataaaaaataaagtgcctcacttctttatcaatgcaaaggataaagaagaacatagtgttgagttaattaatgaaagcacagtaaataagttagactccattatcccttctgaccgaattaatttcgcagcagtggcaggaaaatttgattaccgcttcctgctcaagaacagggatattaaattggacgatgcaattattcgtgaatataaacgattagaccagaacaagaaatggctcatgaatgatgaagacattaagcctgggcaaaaactttatgtttataaggtcattaaagacagattgctgaaaatctataatgacgagcaatctgttgctgatgttttggttaagcatttatataaaaagaaaagcaaatttaaatcaacattatgggagtgctttggcgatctaatattggaaaacatgcagaataatttaaaaagatttaaatcttgttatagttgtggaaagatgtttaagtcaatctcaaataaatcaaaatattgtaataaatgtgcattggaaattgaaaaaaagaaccatcgattaaggcaaaaaaaatacagtaagaaaaaaatgacgaaatagaaagtgtattgagccttactcccccaaggggtacagcgattttaccggaaaaagtttaacgaaaaaatccccttgaacccttgatataactggtctgaaagccctttttgagataatcgccataagggagaaagaaagctaatttccacatataagggtgagtacgtctcccattttttcaaaagaagcacaaacgataccgtaattatactttaacacaaaaataaacaaaatcactaggaggaattaaaacatgaacaaaacagaatttgttggagaagttgcagaaaaattaggagttactaagaaagaagctgcacctaaagtggaagcagtatttaatgtcatcattgaagcactaacaaaaggtgaatcaatcaagattccaggagttggaacgtttgaagttcgtgaacgtgcagctcgtaaagggagaaatccgcaatcgggtgaggaaattgatattccagctacaaaggcacctgccttcaaggctgctaaagctctaaaagacgcagtgaaagcttaataaaatttactgaggacgacaggaaaggcttcctgcacgcctttgtcacatagagcttatgctcctaaaagtggcagagttagaagttatggaggaaattgtcgacctcccctcttttttcatgtattcatctccaggtttattaattagagttcttttattgatggcatgggggtgtcgtcaataataagctgtttactgatatgtgggatatcagttctccgctaatattcatttgtttgaggtcttggatgccagggttttggataagtggatattagcggggtattgccccatcgtggattaagctttttctaaacattgctattctcactttcatacgaacaaaagcattaaattcgactttacagctacaactggtcattgtagttagtcggataatggtcacttatgagggttcgaggttaactcgcatgtctgtatctaaaaagagacaggtaaatggctattatcgggctaaaaatgtcggtaagacttaacgcattattgcaaattgcgactgaatcccatcagggtcttattatgggtggcatatagcctgaatattaattgcggtgtattgcttcggcttgcacttaggtaaggtagatgcgtctcccttccctttaaataatgcccttgtaagctttgatgcttattatgcggtcacataaaaatttttccgggttagcgaggctttttgtaattacatcccctcgcaaaataagtgagatggtttttgggcgattgatcaccgctcccatttcacagaaaaggattattttcggtcttgccttttcaatttcacttagcaacacgttcactttatttcacttcatctccttcaatgttctgtatggagacttacctttcccatgcacatacctccttacacgggtcagagaaaactgtgcaaaataaatggcgagcgtttgagacgctttgtttctcaataaggcgtgtaacccgacaagagcatttaaaatgccattgagaaggcttattagggtcttccttctcaaattatttttcccttggctctcagactctactgagcagttggcaagcaacataaaaacttgatatataagatgtaaaggtaataggaattttaacacgtcccttaaagcgtgtatttttgttatcatagctcatctgccaggtgtagaaggagccagctggatttcgcacagcgataaccagccttttatgctcatgtaccatgatgtacaaggagtttctgaagacgttatttggcgtcttttgttattttcgacttacaaagatttcgaacgatgaacccgtaatcagcgtattccctgtcgattttgcgtacctacgtgagttaatgaatattatgtaaaaaaacgctaatttcgtatatttttcaagggaggacgaaaatgccgatacgtattaaattcgacaaagacgcttacttaaaacgtcatagagaattccgggaaaaattagacgagtttaagagcggcgattatgaggaagcgtataatcaagcgcaggtaatcttagaatcgagtgtcttaaaacctaacgatgcggtggcggaataggtagacgcttagacgaacataaggacgatgctgtgaggtagacaacgggctacttaatagtcggtttggctaacggttgttgaaattcgtccatgcgaggtgcaaatcctcgtccgcataataaacgaatagccaaggcggcgtgtcaagctatcgcagcttgctaaaagccaacagcgccaactatacatccggcattgtccggcagagaagcgagcgagtaagggatgcgtcctgatctcggtgtatagacgcaatcagaacgaggcttccgcaccctacggcggaggtctttttgtgcttgcgttttactttactgatcagccggaatgtccttacgagacttctggtacgcaagttttcaataatctccttcgggcgtttccccaacgcctatccgactcatattttcatctccttatatccccttttcggacgttaccgatgtttcggatcatcgggcttccgaaggagcttattgtacgtaaataaaacaaatattggaggaatttaatttggctaagaaagttcatacagtaaatttaaaaggtaactatacttacattgatgggattattgaagaagaaacaaaaacagacatcgagcgttatgatctgaattctattttaaaatcatttgacggtcggaaagtgaaaatttctattaccgaagaagacgaacttccacaaatcaatgagtaggtggtgactgaatgacagctattttagatactgttttacaacgagaaaaagacgaatcatttactgattatcatatcagacttttcaaaaacaaagacacttatcacattgacacaaaaacaattgctgcccttttaaacaaggatcagggaaccaactatgatgaaagcaaatggcgtaaagactttaaacaatttgagcgctggcacgattactttatctcaaagaatatgaacaaagaagttcaacaaaaacatgaagaaattcgcattgaatccgaaaaacaaacaatcaaagcacgagatcaaaaaagagaatatcggaaattcattgccaatcaagcacggtttgaacaaattaaagatgatgtcgtacaagctattgcatctttagagtcaaaaagaccccttcgcttcaccttcccatcacctgctattgctgaaaaacatggactcgctctattcagtgattggcacttcggaatggaaatcgacaaccgcataaataaattcaataaagaaatctttaatgaacgtgtagaacatctcaccaacaaagtgattgagtatggtaagcagaatcatgtttccacactgcatgtagcaaatctcggtgatttaatcggaggtcttattcatgtgtctacaagagttcaggccaatgaagatgctgtagaacaaattaaatatgtatcagaaacgcttgccgaggttttagcgatgttggcaagtgagtttcaagaggttaagttctacaacgtggcaggtaatcacggtcgcctctccccttctaaaaatgatgtagggattaaagaaaactttgaatacctcattaattggtatcttgaagccagattaaagaacatagagaacatctccattgaacctgagcaagacggattcatccccgctaaaatcaacaatcaggaagtcgtgtttgtgcacggacactacgatcgtgttgatcagtgtgtaacacgattacctcaattacttggctacatcccttcttacatattcggtggtcatattcatcacaattatgaaaaagagtacggcagcacaaccgttgtagtaaacggagcgcttgttggtgcggatgattatgctatgcaaggtcggtttggcacaaaaccttctcaaaaatttatggtttttgatgatgcaggtattgaggctacatacataattcgctttaaaaatgaaaagtaaaaggaatgatcctatgtctgcaaacgattttatagaaatattagcagtgcagtgggacaacctgtcccctgaaagtaagagcactctagtaaatttgattgttaattaatataaaactttaattttataaagatgaggatgaggaagattgaaagaagaaactaaaattctttgggaatatgtaaagctgctaaaagaaattaatgatagtggttatctgtgtaacagggaattaaaagacgccctgacaagtctgcataaaagcctgggatttgagaaaaacactaaaagtgaacaattgaaccgagacgtcaaattctctactaaacccttaaacggaactagctacacattgagcacgggctacaatcctgaaagaattgctgtaattaatcctagaagagaagaaacaacctttttaattattgatttaaataattcccgtattgaggacatctctaagaaagtggagcatggaacgtttaaacatcaggctagtcaaataaaagccattattatagacaaacgaccgagtaagttaataattgatgcaaacggtattggaaaaggtttgctggatgctcttgctgataccttaaaaggaaccaaggttgttttgtccgaaaacggtgccttaacttataaataaaatacttttttagaacgtccagtgatgatttgagaaatctcgactccctctctattgctgggcgttttataaaacgtgtttttgaaccaaaattttggaggtgaaccaatgccaagaaaagctaaagaaaaggaaaaattgatctgtgctgcttgtcaaaaagaaaaggacaaagagtcggggttctataattcacgaagtagtctgtatgagaaaacaggaaaagtccctatttgcaagacttgcttgaagaaaaacattgattacagcaatattgagtcaatatatacagtcttacagcagatcgatgttaaatttgatccgttgtattgggaacaagctgaaaagagaaaaacagatacatttagtgcttatatgacaatggctaattcattgaagcagtttaacggtactggttataaagacagtgtttttgaaagacaaccagagaagccacttatagaggaatctacgcctacaaacaattctggtgttagccaatctgaaattccagatgacctgattgataaatggggtattggttacacccccgatgagtaccgtcagtttgaaagaaaatacaataaacttattcgaaattacggagaaaaaaccacacttcatactgaaggcttgctttcatatattcgtttccgtgtaaaagaggaattagcaactgctaaaggtgatgtaaaagaagctaaagaatggggttcattagcttcaaaggcagctacagatgcaaaaattaatgtatctcagttaagtaagagcgatatcagtggtggagtcgatgtactttctcaattatttgaagccgttgaaacagaattgggcattatcccccttcttcctcgtttagcagcccaaccatatgatgacgctgatctaatcatttgggcgattataaattattacagaaggctcgaagataaggaaaaagtcgattacaaagacatttaccatttttatgatgaaatgcttgaagaagacttcaaatcaaaaggattgtcgcctgaagaaattgataaactaaagagtgctcgcaacaatgttttcagagacttggagaatgtgtacaaagaacctctttatgacacaggtgatgaagattaatggctagttataaaaacttcacctcgaaaaacaagaagcacacaaaaaacagaacagatatttacgacgcagcttttgaaacccctctgaatccagatgacaattcaaacttcattggcaagaatatctccaaatgggctgagttcacctcatttattcgtttttatccagacattttttacgatatgttgaaacccgaagtcggcggaattgagctggatttataccaaagagttatgatgagaacactcagtcgcttccctcagaactacttctgtattccacgtggcggatcaaaatgtgttgcaggagacacagttttatttactgaaaatggattagtagaaattggcgaactattcaattacgaaaaaaaagagtctgaagttgaaacaatacataaaatctcaatgaaaaacagatatggtctaatggaaacttctatggccggcatatcaagcggattcaagaaaacgaagaaaatcaaaactcaagatggctatgacttggaagcaagtttaaatcacccagtattagtaatgtgtgaagatggaaaactaagatacaaaaattctagtgaaattaaagttggagatttattacctatttcaagaaacaataatgtatttggaagtgaaacaaagctaaatgtaagctttgatgatttcttaaatggatttagcaatcaaggcagatggcaagtagaaagaaacaaattcaatattccagaatacattgatgaacaattagcattaattattggttatcttcttggtgatggttgcttgactagaaacaattcaatactttttacaaatgaagacgaagatatattaaataattatatagattattttaacaacgtattaggtattgcagttaagcaaaaagatagaattaattttatcgtatttggtaagctcattcgagaattcttcagacagttaggactggaagaaaaagatgcttttggtaaggaaatacctaaaattatacttaaagcacctaaaaatattgttgcaaaaacaatacaaggtctatttgataccgatggatgtgtgacaaataaaagcgtacaattttgcactgcatcagaaaaaatgagtaaacaagttcaaatgttacttttaaactttggtattatttctttcagaaaaaaatatctaaataaaaaatttaatacttatcattataagatcaatatttctacaaagaatattgatctttttttacgggaaattggatttagttgttcaagaaagcaagaaaaacttatatcaatatgtaacaaaaatcgcaatccaaataaagatgtcatcccttatcagcaagataacattatagcaatttatcctaaaggtaaaacaagagataaattttatcatgttcttaaaggatctaatgatcttacttacgaaaaattatcactattattaagtgaaaatgagcgttttgataataaagatagcgatgaattcaaccatttagtagagctttatgattctaattactattacactaaagtaattgaaacagaagactctgagaactacgtttatgatctatatatgcctttaaccaactcatttgtaagtaatggattagttagtcataatacattgacccagatcatggttgcataccatacagctatttgctttcctaatgtaacgttagccattaccgcttctacaaaggaatcagcggtgaaaatttggaaagaaaagcacgaggaaattttaaggttttacccttccattaaagatgaaatcaagagtgaaaacttttcaaaagacagtggtcgagttgaatttcaaaacggggcgatcatcgataacctggcaaacgcccaatcatctaagggtttacgtagaagacgtggctccttagaggaatctgccttgattgataaagatttatacgatgatgctatcgagccgatttttaacatccctcgtacaaccatgactggcgaaatagatcctgctgaattaaatgggcagattaaccggttctccacatcaggatataaaaactcagatgagtacgaaaaaatccttacgatggttaaggaaactggtgatcttaaaggatcctttgtattcggatcagattggcgcattcctattcactttggtcgtcaaaaaatgtctgttattaataaagcgcgacaagggaatgtaactcgcttccgtcagaattacctttgtgactggattggtgcaagtgacggcgcattgattaatatcagtaaattgatcaaagctcggacaattacccaccctgaactttcttgtcctagagataaaaataagaacttcttgctacatgaatatgtaatcggggtagacgtagcccgctctgcggctgaatcaaacaataaaacagctatcgttgttttgaagataatcagaaacagcaataacctcattaggcaagttcaagtggtcaatattatagagccaccaaacggattgagttttaaagaacaatcaatcatggtaaaaagagttttcaaaaactatggaggaaatcaagatacttctctctcaagagttaaagctgttattgtcgatggaaacggagtcggtggcggtttaatcgaccggttattagaggatgttacggatccggagaccaatgaagaacttggatgctgggccacaataaacactgatcaaaagccagatgtcccaaattcgccggaaatcgtttacaacctaaaatcccaaggtattaaccaagacattattactcaattcctggattatgttgagtccggaaaattgaagttgcttaaatcctatgatgacatcaagaaccaaaaaagcatatctgatgatgtaatgattgaagcagcatgtattcaaactcaattgtttattgacgaagtagcaaacctcagaattaaaaagacacagaattctttcactgttgagcaagttgtaaaaagaattgataaggataggtacagtgcaattgcttatgcgctgtattacatagctttatttttagaaaaggaagaatccgatgatgagtattcatttggattcttttttaattagaaattgaggaggtgaataatgactacatctgaaccacagtcatcatatgagtttaatacaaatttagcgccgcttgattcattgttctttaatgatttatttaacggtatttcttacgacaaagttaaatcatggctgaaagaccacaacgtctacaataaacagattagggatgcctctaaattgctttataacgcaaatggtgtgtatagaaacgttattgactacatggtagccctccctactttagacagagttattttgggatcaagtaaagtagctaatttcaaatcgaacaaacaaaagttcaatctggctttaagaaaaatcggcgacaaaagtgctgtcagggatgcattaggaaaactcagcaaatatggcactggcttttattattttgattctgtagtggatgattctttccccaccactctaagtgacaatgagatcggatcaataactgaatcaaatgctattgacgactttaattgttccgtcctccctcttcctctcgattattgcaaaattatcggaaggaaaaattcctcttatcagttagcttttgatgtctcctattttgataagttcacaagtaacgggagatcgctcaagcttagacgatggccagaagaaatcagacaaggctataggggttataagaaagaccaaaatcgaaaatggttagttcttgataacaataagactattgctgttaaaggaagtagcgacattgaagatcaatggggacgcccaatcggtttatccgcatttattgatatggtttatgatgaatactttgttgacactaaacgaaacattttagatgagctcaacagcactttaatttatcagactttccctgaaggtgatcaaaaaggcaaatcagccttatctcaaaagcaacaggagcagcagcatgagaatataaaaaaagcgttagttgctaaaggaagcgttaaaggtgttaagttcttctctttggcctctggaacaaaattagacaagttggaaactaatgtagatttcttgaaggttaaaggtgaagacgagctcattaaacgaatcactacaaatttaggatttgcaggatctgctctcaatggtcaagacggtaactattcttctcaacaaaccaatatcgagatggtttcttcccaaatattctcctggttagaacaaattcaaagtgagtttaacaaggtgataaacgccaatatcatcaaagatcctcgctcttatattgaggtttactacctccctcttacccacgttaacaggaaagaaaaagtccaaaacatgaaagacctttatacaagtggtcgaggaagccttattgcttggatagccgctactggatggaatcctgatgcttacttatccctaatggaatatgaaaaagacgaaggttttgatgaaaagttccctgttcatgcgacctctttcacaatgagtaagaataacgataagtcagccggcgcacctgagatcgatgatccgaaaaatgaaaacacgattaaatcgaagacaaataacagtaacggaacgccttctggctcttgagaggaggtgattagtatttgaaaagcacgattttagaaattaacaatcagaaaaaaaccagtggtcaaacatacatcaagtgggtcgttctcgaaatccatgaaaacaatactcagttcaacaagaacggtattacctggctggagaaatacataaacgctaaccttgaatcaatcaagttaatgccaatttgcgcagaattcttggatgatgaaaacagtgagccattcggacacggtttaacagaagtcaaggacggcacccctctctttgaaaacagcgcagtggttggtacgactaccaatgcttacattgacactattgatgttaatggtgagccaaaaagagtgttaatagctgaaggcttcctatacaaccagcgctatcctaaatttgttcaatggttaaaatcaaaaatgtttgatggcgatttccctgagacctcggttgagatagcagctgtagaagattcagatgcaattgaatatgaaggtggctggaaagagcaaggacgtatacctatgaaatttgactttacaggtgatgccattttaggtattgaccctgcagacgacgctgccattttgcttgaattaaacagtaaaaaaaaggaggataatttaatgccaaaatctcaagaagaagtagtccttgagttaaacaacaaacttgataataagaataaagaaattggagaattaaatcaaaaagttgagaaacttactgaggacttaaagcaaaaaactgaagaactgaatgccgctgttaaagctgcaaaggatgaaaaagctaaggctgatgcaaaagaaaaagaagcgcaaaaagctaaggatgaaaaagccaaggcagatgaagagcttaattccctaaaggaattcaaaaacaaggcggtagccgaaaagatgcaaggagagcttaaccaagctttaaaggaatattctcctgaagaaaaggatgtcgcaaaagagaaaattgaaatgttctctaagtctccttctgtcgagcttaaaaacgaaattatttctgaaatcaactcagcaatcgctcgatccttcatcactgaacgctcaaagaagcaagcctctgagactaatagcacaaatttcgatatttattcagaagttcgtgattctgggcaacaaagttcagtgactattgatgatctttattaagataaaataacacttttataaaatttaggaggaatactcaatgttcaaattcggaacaattggtgcttataaacaagtacgaaataatccacgttgcaaggctagtgtcgatttagtccctggtctagtcgtaatccctaacgattcttctggtaacgcattccctccaggtgcatcttcaactgcaaaaggtgatgtgtatgttgttggaaacattattgataaacctgaaattcgcaataaagaagacttcaaagttctaaaaggtgaatatgtccttgcttttaatttagctgacttaaaaggactgccaattgaacttagctcagacgtagtagttgattatgatgcgcttgttaaagatgacgtattggttcctgctgcagacaaatcaggtaaatgggttaaagctggagatgacgttgcagagtttaaagtatctctaaaagtcttagagaaaaatacatttggcggaaaaggtttgtacctaacagtacaggcttaattatattctggaggtaattattaatgtttacagttgaattaaacaatgttcaaaaagactcaaaccattatgcaaatgctaaattgaatgctaagtcccctattgtagaaatcttttctgcagctgcaacaggtcaagatctttccaagtttggagcaaaagccaatgctgctatgacccatgtgaaggaactagcttccaaagctcttatgggcaaccctgtagctaaagccgagatcaacacaattgtgcgttatgccattgagcctaagcttatttcagcaattaagctatttgattttatgggcacatttagaactatcggctatgatcagcaaccaatgatgacatcatacgcgcatgaatccatccgaagccaattccaagcttcccgtggtgacgtaccgttcgctactacaacttggagcgaatacccgattggaactcaaaccatttcttctggctatgctgttaactatcgtgagattcaaagtggaaacctcgataaagtagcagaaggcatggagcaagttcaaacagatatgatgaacaaagcgatgtactatgtagtaaatgaaatgttcaatgcaattaaaaatgcaacaggtgttaaatactttgctgaaactgaaggtatcaccaaatcatctgtagacgatattatcacaaagattcgccgatttggacaaccttctattgttggtgacttttctgttgtttctcagttaaatgactttgcagggttccaggctgtaaccggagatgcttcaagcactaaactccctcagtctgttatggatgaaatccgaagaacaggattacttaacacttataaaggttcttctgttgtagaattacctaatgcttataatctaactgaattaaataaagccggcgataacttcaaaacatatcttcctgaaggacttctcttcttcattcctcaaggtaaaaagtctcctcttcaagttttccaaaaaggcggactcacatcgatgaatggtaacgacattatcactggaactgagatcactcgttttgatatggaaattggagctggtgtagccaaaggacaagaacatcaaattggtctcatcagagacacaaaatatgaattaccacaaatttaaacaatttaaaatttaggagggctgtgtccctccttttatttttggagggattacatgtcttttaatttagataaaaagattacaattaaaaatttatgtccatgggatttatatttccgaaagattgactctcacggtgacttcagattgccggccaatggaattagacagatcacagctggggaagtgcaatcccaagtctatgacaatacctcactatttactggaactgacggtcaaggtactcatgccaaaatctatattgatgacaaagaaacccgtgtgcacttaggttttgagaccgaagataaagacgacaaacaagaaattgttactgtagaacgaattaaacaaatcttgggatacaaaacccaaaaagccttcgaagaaaatgttcaaaaggaaatcttacttgagtctgaaaaagctcagctgtttgatgtagctaaaaaagaaaagattaatgattacgctaagatcaagttcattgaagaatacactgggtttaaatttgatactcaatcataagggaggttaaatcttgactccttatgaaaaaataattaacgttttccactcaatgtttcaatcaaatgaaattctccctgatggccttgaacagcagtttttcattaacgcagttggtgaatacgaaaccgaactgacagaacttggttatgatgaaaagtccaatacatttaaatatccccttacttcatcacaaattcaagttttaggaatgcttatgtacaaaggattctctttcagatatcgagacagagccttaaaattaaacaacgttgtaggaagagatgttcaattgacaggtttatctaatactaaagctcaggttaatagatcctatgaagatcttgtcgatgagattgaaaaaaaaatgagcaaactgaaagtgaataactttgattgaggtgattagatgtctatagattggtatctaacctcttcttcaaattatttgagtggctgggaaaacgaagagtttaattcaaacaagtatgaaattttcaaagaaatcttagcaaattcacctgaaacttacgacattgaattgaatggtaagccagaacaggtgataattcaaaccactcaggacagcgaaacaaaaaaagtccttacagttttaggcttattaaatcgtggagacttgattttgtatgacggtagttactggttagttaatgcgcgccccactgataacaaaatgaatgacagtgctactatgcggctttgcaattcatcaatcagtctaacatcttctgacaaacttattgattctggaaagattgatgaagttacagggagaccgataaagattaaagtgcctggtgagaaggttgacatcccgtgtgtattagaacgaacaacctcaacaattggatcagaattggctataaacattcctgaagggcaagcacatgtcaccatcccttttttaaaacatgaaaaattaaagaagggtctttttctttctttttatggtgaggaattccgtgttgatgatatagactattccaaggtctatggagacaccggaacaattagacttatagccaaaaagaaagttggaggtgatagcgattgagtatgatggttgaacatatgacaactgtatttagaactattatgaatgatacagaattgaatcgtcttttatattataaagatgaccctctctcctcttctctccctgatgttcagacgttggaaaattattatgatccagttgatgattccccatcaatattaagctcaataattaaacgtgctcccaaaactgatgatttaaccgatcaaccaatatgcagactttgtgtttatctcggcaatggaatccctaaaccctcaacccaaagtgtgatgctgctagatcaagacttgatgattgatgtttatacacacattaacacttatgaggagaccgaattcaggaacctgaaaattactgatcgtatttgtgacatgctcttcaatcaaaattttgctggcatcggtaaaaatgttaaatatacaaggttgctcatatcaaatgcgcctgaagggtacttgggatacaaattgatattcactttcggagcaagtaaatgaatgtgttaaaggattttttctttttaggaaggcctattaatactgaagtcggtgcaataaactttatccacttaagagattacccagagtacataagcgagctaaatatgatgaaaatgagcaagaaggaaatcatcagaaacttttcaaaaatcaacaatgacggttcattaaatgatttaattatcgaattgaagaagaatagtctcttcaaaattgttcatgattacttacccgaatttaaccaggcttattttaaagtgtttagcaaagtatttgtggacaaggaatcactacatcttattgatcagagagcatttaacaatgttagaaaattgatattagagatgcattgcctgactgaagagaaaattgttgagaatgatgaattacaggagtttcatgatttgaataatcaattaaaactccaaaattctcaaaatgatttaaaggacatcgctagctgtgtggctgcatttaatggatacacatatcaagaggtagccgatatgacaatttatcaattgtacctgtcatattacagaatgggtgaaataatgaattataacacttctgcgttatttgccactgtatcaactgatgtgaaaatcggtgactggaatagtcatgttgatatgtatagagaagaaaaacaccacctcagtacagcagatgctaaaaatttagagcaattattcggagactgattcacagtctctttttcattttaaattaggaggaaaacacttggcaaaacaaacagttatccatgaagttggcaaggtgctaaccaaaagacttagtgaccacaaggttgttgcatcttctgtaacacaaatgactcagttctcccaacaagtccaacaagactttttaaaaggcggatggggaaatagagacctgtatgtcatcaactcaagcaaagaggtttcaggcaacgtaaaaaatgctttctttgatcttgattttatggcaatgcagcaaggtgtaaaaattgaaaacgagacgatttctgtatgggaagatgaaagtcttactgtaagtgataccggcacaatcaaaatcgcgtatactcctttatccaaagtctcacttacaaatgaagacggagatcaacaagaatttaatgtttcagacaaaacaattactgttcctgaaacgtttgctgctaaagggaacgctgtaacagctcactatcaaattgaagttgatgcagaaacagttgaaattagtggtgaaaaattctccgagaactattacttcgaaatccacacacttgagtacgatccaaagacatcaaaaatttacagtgacctttatatccagttacctaaagttaatttctctggtgaagcagacatgtccttagaggctggacaagcctacacacctgaaattggataccgagcattagctgatgataatggcaagatcggtacttttgcccgtgttaagcgtaaccctgatgggacaaaaggaattaaaactgaacaagaagatgcgacatcgaatagcagtgtagacattggaacaacgcaagaaacaaaataacgttaggagcttgatatcttggcacttttaaacaaagacggagacatttacacttcagctagagacgatggaactggtaaaccaatcaccgatattcatctaaaatcacaagaaaaaccactacaagttgactttcctcaagctggtttggatgctatcaaaggcatccaagtacaatccccttccgtgaccttgaatgaaagagatcctggtttctcctcttttaaaacggataaattcactgttacttcaacagctcaaaaagttaccgcaggtatcactgacagaacagcacttactatttacccacctgcagaaggcacgatttacattgggaactcaactgtaactgctgatacaggtatcccattaacagccggtgacaaacctttttcagttcctgtcgccgctggtaaaacactttatgtctatgtgatcaatgacggtactgacagagacgtaagagtatttgaagctaaataatttgaggggattcttcccctctcctttttaaataaaagtcagtttttaaacagatttaggaggtggagttgttgacagaaaccgatgaaaatattttaaaaaccattccagataaagcaacctttacattccacgaagcaacaactgccccgtctgaaggtgaagaatttgtagtatcacattatcgggatattactgttaagatctctggttcctcaacttcaagagaaataaaattctttgctgtagatgaaaatggcgaaaagacagaaattgctggaacaaacaaaactgattttcaattaggtacgggtacattgaatacaaatgaaaactgggatttcgatattgcggggcttttcaaattcatggttgaggtcatttccgtaaatggagatgttacggttaaaggaattgcggtgagttaatgagcagcagtaaatttgtaggtcagctcaaacaaaacaatatacaaatcaataaccttaaagatcaatttttcagaactgaatctcacatgtctgatcatgaaaaacgtttatccgataaggtcgatgagttcatggaaaagcaaaattcagaattaaagtcgcatactcagaacatagaaaacccgcaccatgtaactaaagagcaagtcggattaccaaatgtacttaatgaagagcaagccacaaaggtggcttttgatggacatcttgacgacaagaaaaatccccattcagttactaaaagccaagttggcttatctaaggttgataatgtacagcaagcagcgaaaattgattttgacgctcatgatgcagacctggatcgacatatcacaaaggacgagcgcagttattggaacagctccgatgaaaggtcaaagtcttttttagctgaacatactaacgatcaatcaaacccacacaaggttactgctgaacaggttgggcttgggaatgtagacaatgtaaaacaagctactaaaagtgactttgataatcatctgaatgacactaatgttcatatcagcaagtctgatcgagaaaaatgggacgctgctcaacttttcaaactcactgacgatgatgggaaagtattctacaaaggtagctccgaaaaaacggagtacaatgatttgattaacactgggttttatttaatcgcaaatcaggggcttcactcccctgccaacttatccaatgtctatttagctgtcatgaactatggaactacgattgcacaattcgcattagaagcatattacggaacacatacttatttccgttttagaaagagcgattcaacatggacttcctggcaaacacatgagacgactgacggagcacaagcaagagctactaccgcactcagctcggcgaaagcttacaccgatgcccacgaagcaaaaactgatattcacgttactttagatgacaaagccagatggagtggcacgtcaggttcttggaacccagttacacttatcaatggagctacacaatactccacttaccctttcaaattctcaagtgtaaacaatgtgttatggctaagaggatctttcggaacattgccggccattggaactgcagttgctaaattctcaaccaagccaacacagctagtggattttgtagtacccacaattggatcatatggaacagcgagatttgccttcacaacagatggagatttacgttttgatggattgtatgctaatgacattaacagtgtttccagagtttcatttaatataggaattcctttatggtagtaggtgaaaatattatgcatgttctttattatgatgagaactttatgtacgctggagaagacttcattgaaggcgatgctcttcctccaaatagtacaactgctgtcccagaccccacaataatcttgcccaaatatgatcccaagaaaaataaatggattgaatcagcaactgaagaatacaaggatagcgttaaaccaagtatccctgaacctaacgattttgaaataataggacagaccctatcccaactccgcctaagcttgcttcaagtcaacaaaacaataaacacaatgttaaaagatattgctgatctaaagggaggttcataaaataactacatacaattattgggttaatgccctgagtcgaaaatgggcaaccgtcgatcaagtcaaagaagcttaccaggaattcaacgatgtgacaaaagaagagctccaattaggagtaaagaatggtttagtcactttagaagagtacaaagaaatcaccggcgaagactacgaagaagcagacacagaataaaatacaagttttatttagacacctctcccctattgaggtgtcttttttaatgtgtgcagaggatatataaggaggaaatgagatggcatcgaaaaaattaaatcttgggttgattgaagaaagtgtaagtaaatatgacaagaaagaacgagtacaacttactgaggacgttcatgtttttatttacccttacttctcccctacccgcttaaccaaaatgcttactgaattaattactgacccacaaaatgctcaagaaaaaaacattgactttaaaagcataaatcctgttcaatggggattcttttcactaattaaagaatttacagacttgggtattccaagtgatatcaaaaacaaagttaagtggtttgttaagcttgtggactctgaatttttcccattgattattagtagcttccctgaagaaagcatgaagaaatttggagaagcaacaaagatgatgcaagagaatttagacaaactttcaaacatatctcctgaagaaataaatgatctcatccttaataaggtcgaagagattgagaatgaacaagaggctgaataatggccaagaacataaaagaaatagcagcattaattgaatttgccgcaaagcaagccgttcaaaaacaatccagcacaaaaaatacgatgattaaaacgggtcaagagcatgtacaatctgatgtatatgacacatacgatcctcttgtatatgaacgtacttctcttttgaaggactcctttgtcattcaaaacgaatataacggaatttcattagacaacaaccgtgaagacaacggcaaggatgttgctacggttgttgagactggtcaagggtacacgtatccagataaatacggctatggttacggaaaacctcgcccagtcatgaagaatactgctgaatccttaaaagatggacgattagttgctgctatgataaaagatttaaatacaagtggtattaaaacagaataacggtggtgtattaatggccagaaaaaagatagcatatgcaacaaaagaaaaggtcaacaaaattaaccccaaaaatgcggaattaatccgaaagtattttgtctttaaaaacatgaacctttcggaatccagtaaagtgggatatcaatcagatttcaatcaatggctggtatacattttagagaattacaataatcagcacattgtggatattattaaagaagatcctgatgatatggttgatttaattgaagactttgttgcattttgcaccagtattctaggcaataatgaacgaagaattcagagacgaatgagtagtattagctcattctttttatttttaaggaaaaaacgtaagattaaagagaatcccgttgacttcttagacaggcctaaagctggaactggtgaaaaacttcaaattaaacagaccttcctaacaaaagaacaagtcgaagaaatcagaaaaggacttaaaaagaaggaaaatattcagttagagctcttctttgaattcggtctctcaacgatggccagagctaatgccataagcaacgttaaggttgaacaaattgactttgaaagacttcgggtggaagatgtcattgaaaaagaaggatataaagtcaccctcttcccttctcaaagagctattgatcttgttaaggaatggctggagtacagatccgaaaacggaattgaatgcgaataccttttcataacaaagtacggaggcatatggaagaaagctgaaaccggaactttacaaggatattggataaagagaatcggagaaataattgatattcctgaattacactgtcatgatttaaggcacagtggtagtaaccttctgtatcacagtggcatgagtctagaggacgtgtctcaattattgaaccataaaggcactgacgtaacaaagaatcactatctagaagtaaacaaagatgctattcaagacaagaaagcaaaatttgaagtgtaaatgaaatccctcttttatgcagaatcaagatccttctaccgaagggttttgcttatggataaaaccttaaacttatttccatatttgacgataatatggagaggtgaaaaatatgaataagacaatacttaaacacaatttagtacagatgaatagtcgcgacctgatcaaatacatacaaaaagaattcccgcactctggtgagctctacacagaacaaaagcgcaaatttcaaatcctaaaatcgctcaattcatcagatttaattttagctatttcccgtatgagtcgaattgaagcgtccttcgatcatacgaaaatgtggacagttggaagtgtgctcataggaacatgtttactatctctcagaattatgtttagttttaatttgctttggtatattctaatcgcaacatcgatttgccttctcctactttttgttgtacgaaaggatagggacattgttattactgctacatattttaaagaattacttgagcagattaagtccgaaaaaggaaagtgaccctcccctttgctagttctacacttttggaaatcatgatataatgtaggaaaataatactggtggtggttggatgggctataagattatggcttatggtggctattttttattcagccttttcttctgtttaatggatggctggagacctttgggggtttttctgataattggcggtttggcttatttagcgctcgaaccttacagaataaaaaatgcaactgttgctgaaaagattagaaaaaatgctgaaacactaaagacctatgatagcgaatttaaccctgataatttctttagcacttataaaactaaaattgcttacaatgaagataaatctatccttaaggtatatcagctaaatggagaagaaataaacgagtatgttgtcccttttgcccaaattattcaatctgaaatctcactggatgaccaggtgatttcgaaggttgccaaatcggggattattgctggaggattattaggcggcggaattggtgcaacaattggtggtttgtcagcctcctctactcaaacagaaatggtgaagtcaattacgcttaaaattacagtcgaaaacctcaaaaatcctatacactatatccacttcctcccttctcgcgaggatgatggatatgagcctcaaggttataaaaaagatgggaatatcatacagcaagctttaaaaaacgctgagtattggcaaggtgtcatggatgtaattatcaagaaaacaagtacagtcgctcaataatttgagtggcttttttatttgctctgattagccccacttgaaaggatgtgacttatttttgagtcaagatttaaaaataatactgaccccaaaagctgatacctcctcaaagactgtcgaacagttaaatcagcaaattaaatctttagagaaaaagcttaattcccttaatttaaagaccaatattgatgcctctgctttaaagactctcaacgaattctcctctgcagttgacacttaccaaaaacatctcaaatccttcaatcaaacaattaaagaaaccacaacggttaccagaaatgccgatggcactgttgaaaagctgacgcagcaatataagaaaaatggcgaaatcattcagcgtgaaaagaaattcatcgacaatcgtaatcaatcactacgtgaacaaacccaagaagttaacaggcttgctcaagcgactgaaaaactaggtcaggtacagaaaagaacagaacagaagaattctcaaggacaaacgacgagggtaactcaaaagaaccgcaatggcttcgatgatataacatatacgactgatccaaagacaaatgctacgtcatcaaaagttacaacaaattacgatcagcaacgaaaagcaattgaacaactaaagatagatttagaaaaacttagacagcaaggaattgtaactgacaccaccctctcttcccttgggcggaaattaaacactgctcaaacagctcaacaaattgaagcattacaaaacagaattaaaatgctcgatgataagtctgctgctgtggctaaaaataatgaactccgaaaaactattgagctttatcaacgccaagcacaggtaaacgtacaaaaccttaatacgcgttatggcgatacgatgggcgctggaaatagacaagctatccaagagtacctcaatgcagttaatagccttaatgtaagtgccggcggaagcaatatcagagctcaaatgcaaagcttgaacatgcaatacagggaattggcttcaaatgcgcaagcagcagctagtcaagcctcgtcttttggtgcggagctaacgcaagctttcaaaagtatgtctacatatttaatctctggttctttgttctacggcgctatatctggactcaaggaaatggtatctcaggctgttgaaattgatactctaatgacaaacatcagacgtgtgatgaatgagcctgattacaagtacaatgaacttcttcaagagtcaatcgatttaggtgacacactttcaaacaaaatcactgacattctccaaatgaccggtgatttcgggcgtatgggcttcgatgaaagtgaattgtcaactctaacaaaaaccgcgcaggttctacaaaacgtctctgacttaactcctgatgacacagttaatactttaactgccgcaatgttaaacttcaatattgcagccaatgattctatttcaattgcagacaagctaaatgaagtggataacaactacgctgtaactactcttgatctggccaactctattcgaaaagcaggaagcaccgcttcgactttcggtgttgaattaaacgatctgattggttatactacagcaatcgcaagtaccactcgtgaatcaggaaacgttgttggtaactcacttaaaactatttttgcccggataggtaacaaccgaagcgcaatcaaagcgttggatgaaatcggaatttctgtaaagactgcaggcggagaagcaaaatctgcgagtgagttgattaatgaggtagcagccaaatggaacacattaactgatgctcaaagacaaaacacctctattggcgttgcaaatatccatcaattgtctcgatttaatgccttaatgaacaacttctctatcgcccaaaatgccgccgcaacagcttctaattctgcaggtagcgcttggagcgaacagcagaaatacgcagatagcttacaagcaaggttaaataaacttcaaaacaatttcactgaattggctatagcttcatcggatgcctttattagtgacggattgattgagttcactcaagctctgggttctttgttaaaagcctccactggaataattaacactgttggtttcctccccctctttttgtgacgattagcactgctacattgttactcagtaaaaacactcgaactttagctacaactcttatattaggctcaaaagcaatgagacaagaaaccttagctagcatcggattagaagcaggtatgacccgtgctgctgttgcatcaagggttttgaaaactgctcttagagggcttttagtttctacagtggttggaggcgcgcttgctgcgttgggttgggctttagaaagcatagtttcatctttcgcagatgcaaaaaaagctaaagatgattttgaacagagtcaacagaccaatgttgaagcaattacaaccaacaaagactccacagacaaactaataaaacagtataaagagcttcaaaaagccaaagattcaagaaccctttcatcagatgaagagcaagaatatcttcaagttactcagcaattggctcagacattccccgctttaattcaaggttatgactctcaaggaaatgcaattttaaaaagtaataaagctttagaagaagctattgagaacactaaagaataccttgaacttaaaaagacggaaactaaagacagcgccaagaaaactttcgaggacgcttctaaagaaattaaaaagtctaaagatgagttgaagcaatacaaacaaattgctgattataatgataaaggcagaccaaaatgggacttccttgctgatgatgaagattataaaatcgctgcagataaagcgaagcaaggtatgcttaaagcacaatctgacatagcaagtggaaatgcaaaggttagagacagtgttctctcaatcgcccaagcatacagttctatagatatcagcaatactttaaaaacgagtatcaatgacattgtaggtaaactcactttaaaagatgatttgaatcctgatgatctcgataaattctcttctgcattgggtaaactccaagagaaaatgcaatcggcattgaattcaaacgatgaaaaagcatttgatagcgcgaaaaaggatctgcaaacccttttggagacctattcaaaatccagttcttctattgatgtctttaagttgagttttgataaggcacaaaagaacattaaagatggagataaggccatttcttctgttaaatcggaagttggtgatttaggggaaactcttgctgaagcaggtaatgaagctgaagattttggtcaaaagctcaaagaagcgcttgacgcaaatgatatcagtcagattaaagatgtaatcaaaggcatgtcagagtcaatgcagtttgactctgttcaaggcattcttaacggggatatttttaataacaccaaagaacaagttgctcctttaaacgaacttttagaaaagatggctgaaggaaagagcatttctgccaatgaagctaatgctctaatccaaaaagataaagaattagccaaagcaataagttatgaaaatggtgttataaaggttaaccgagatgaagtaattcgtcagcgaaaagttaagctcgatgcctataatgacatggttcaatatagcaataagctaatgaaaactgaagtcaataatgccattaaaaccttaaacgctgattctttacgaattgacagccttagaaagcttcggagagagcgtaagctcgatatatccgaggcagaattgtctcagctcgaagttaaatcaatcaataatgtagctgatgcgaagaaagaattacataagattgaagaaaaaatgttgcaacctggtggattttctaacagccaaatctctgcaatggatagcgttagagctgctcttaaatcctacatctcagcatctgaagaagctacatctactcaggaaacaaacaaacaagcgttaatagaatcaggtacttcccttgaaaaatggacagacgagcaagagaaagcaaatgaagaaaccaaaacgtccatgtacgtggctgataaatacaaggaagctctggagaaagttaatgctgaaatcgaaaagtacaataagcaagtaaacgactatccaaagtattcccaaagttatcgaaatgccctgcagaaagaaattaaagctcttcaacaaaagaaaaagcttatgcaggagcaagccaaactcctcaaggatcaaattaagtcagggaacattgcacaatacggtatagttacctcttccctttcctctggttcatcttctggtggttctttttcttctggtggtgggtcttactccggtaaatactccagctacattaattctgccgcaagcaaatacggtgttgatccagctctaattgcagctgtaatccaacaagaatcaggattcaatgcaagagctcgctctggagccggagctgctggtttgatgcagttgatgccttccactgctaaaagcttaggcgtaaacaatgtttatgatccttatcagagcattatgggtggcacgaaatatctagcccaacaactaagcaaatttggtggcaatgttgagaaagcacttgctgcttataacgcagggcctggtaatgtaattaaatatggcggcgtccctcccttcaaagaaacacagaattatgttcagaagatcatgtcaaattacacgaagtcaatgacttctgccaattcctccattgcaagctactacacgaagaacagcgcgtttagaataagttctaagtatggtgctcaagatggcgcttaccgatcaactccacataaagggacagactttgccgcaaaagccggtactgcaattaagtctttgcaaagtggtaaagtccaaattgctggttatagtaaaactgccggtaactgggttgtcattcagcaggatgatggaaaagttgctaagtatatgcatatgcttgataccccttctgttaaagccggtcaaactgttaaagctggccagaccatcggtaaagttggcagtacgggtaattcaactggaaatcaccttcatcttcaaattgaggaaaacggaaagacaattgaccctgagaagtatttaaaaggtgtcggtacatctatttcagatgcgtctcaagctgaagcagaacgacaacaagcaatagcgcaagctaaatccgacctcctctcccttcaaggtgacattaattcagtaaacgatcagatacaagagcttcaatatgagatcgttcagtcgcatcttgatgaatatgacaagcgcattggtgattttgatgtaagaatcgctaaagacaaagccctcgctagtcattatctgagcgatagtaaagagttccgtaagtatacaaacgatcagaaaaaagctttaactgaacagcaaaagattcagagtcagaaggtttcttttattgaaaaagaaatcaaaacaaacaaaactctgaatgccgctcaaagagcacagcttgctgaggaattaaaacaagctaagattgatctcatcaatttccaagaagaagtaagagaacttcagggacagctcatccaatccaaagttgatgaaacgcttaacggtatagagaaatcaaccaagaaaactgaatccaagcttaaagatgttagcaacaaaatatccatgaccgaggaagataaagacaaggttaaatattatagccaacagattaagcttattcagcagcaacagaatgaagcgaagaagtatataaaacagttggaagcacaaaagaaagctgctaaagggttcccggatattcagaaacaaattactgaagaaatcgagaactggaaagacaagcagaaggattacaatctggagctttacaacacaaagaaatcaatcaaagatgtgtacaaatcccttgctgatgaagttgtctccatctataaagagatgtacgaaaagatgcgtgatattgaattaaaagcgcaccaaaaagcaacacaagacttgattgatgagatcgataaaactgacgatgaagctaaatttcaaagacagttaaaagagaagcaagagagtatccaaaaactcactgaccaaattaatcagtattctcttgatgactcagaatttggtaagtcaaaggttaaggaattaactgagcagttacaaaaggaacagttagatttagatgagtttcttaaagatcgtgaaagtagcaaacgtaaagaagcgttgcaagatcagcttcaaaaagacgaagattcaattaacaagaaatatgatgatctcgtcaatgatgagcgtggatttaaggaacttgagaaaaagctaatggatgggaagattactgatattgctaagcaactgaatgaattctctaaattcattaacagcaatatggagtccattggtaaaagtatctctaataaccttatcgataagcttaaagaagcttctaatgcccttaatactgtgaccaaaggcaatacaacaggcaaaaaaatatcttcatttgaaacaggaggatacacaggaacaggtttaggtgctggcaagcttgctattcttcatgataaagagcttattctgaataagactgacaccaagaacatgcttgaaactgtaaagtatgttcgcaatctgtctgataacgatctgaataatgaaacacctaaatgggggcaaggtggaaaattagcagctttgattaacaaagggattacttctattccatcaataattccgaatattaaccaagcgagcctatctaatagtttgataccaaatgttaagactgctaacctgccccctaccacaaccgttaattctaatggtgataaaacaattaacacaccaataattttcaatgttgataaacttactggtggggaaactggagccagaacaatgctcgaaaccatcaagaaagaagttataaaattaaatggaagcatgtaagagtctgtataatgcaggctcttcagcttgctttttgattggtaagggtggaattttatgattagagaaagtcaatatttcatgttcgatgatatcccctcttatgaaattggggcagtgaatgtaaacacagagggcggactattggaagagaccttcgtagcgaatagaacagtaaatgaaacatatacacgatcagcttctgaaccgtatgtagacagtgttaaacgtgaaccatatgaaatccctttaaacttttacatagaagatcatttagatgaagaaaatattcgaagagttgcacgttggctaaatgtagatgattataagcctctttcattcagtagtaatttagatatcatttattttgctttgccagtgaatgcaacagatttggtacacaactgctctaatgacggatatgtgaagctgacaatgaaagtatttccttataggtatggacgagaaacaactacccattggtatgacatatcatcaggttctaataatatagaaattaaaaatataggggatttagatatcccactctctcttgaattcaaaaaaatcggtgatggagacatcacagtcgaaaacttgacagcttataaagaacctctaaaattcacatcaattaaacatcaagaagttattaatgtagatgccaataaagagctgatcacctccagtgttactgggtatgagtgttatgatcaagtcaatgaacagtatgtttttttaacaagggggataaacagagttaaaataacgggcgaatgttgtatccggtttatatacagatataagtatttgtaaggggatgttttattgatttacgattttaaaccaggccatctcaaggtttctttagcaaaaccaaataaaaagaaaatcgctaatatagtagatttctctaacgcctctctaaatttgaattttgatgaactccacgatctaacttttaatatcccacttaaagcaagatataatttcaagatgaagccaaaccatgtggcagaactcataaaaggctggtatctcattaaggcagagttcttaaacagagttgaatggtttgtaataaccggattgacaaagtcagaaaatgaggaacaaacaatacaagttagagctcaaggacttccctacattcttcataaaagcaaaatcaaatcatatgaaggcatctctaaaaatctgttggaagttgccacagattgtcttaaaggaacttgctttactgtagactttattgacccctcttttaatgaaaaacgccgctcatttgatgttacctctacccgatatgagtttttaaagaacattggagaaacttttgaggctgtgcctatatttgatactgtgaacaacacagtatcattttataaaaaagaaactgtgtccaagtataaaggtgtccaattctctcctaaaaggttcatgattgatatggaagataccattgatattgatgaagttgtaacacgattagacattaccggtaaagatggaattgttattaattcagtcaatcctactggacaaagttacttggatgatttctcttatttcctctacccttttgaacgtgatgaaaagagaaatgtaattaagcatagtgattacatggatgatgatttgtgccatgcaattttagattacaatgaacttgtaaataaagaaggctcttctttttacctccttttaaatcagaaaaaagatctggaagcaacaaaaacaacacaggagaataccctcttcaccctagaaaaaattgaattacaacaaatcttagataagatcacagtagcaaaaaaagctggagatgacacgaaagaccttatcaagcaaagagatgccaaacaacttgaagttacatcaaagaaagctgaaatatccaccactgccaatcagatttccaagataactgaagaaatagcagtgttaaaagatcggttatctatggataagtttctcggtgaaaagctaatgaaaaagttgtcttattttatccgtcaagatgattggtctaatgacaacatttttgatgaaacagagctgtatgaaaaaggccttgaggaacttggggagaaaaatacacctccggtagacatcagaacaaacattgtcaacttattcactgtcaacaaagaaaaggatttttgggatagaatttacctgggagatataatcagattagttaatgacgattttagaactgatgtcaaagcaacacttacaggaatgaattttgattttgagcagcaaagtatacaagtaacactctcgaatggaaaaagagctactacgatagaacaagactttgcacgctcattgtatactgctaagaaagcatcaactgaattcaataagaaaaagattgattatgataccctactgaccaattacaatgcacgaaatgatcgtatatctgcacccgtagcaaacccaactatccgaaatgacgggactgctataactcatgttgtaaatgataatggatctgtagatgtatcaattgaatgggattttccagactccgatgaggataaatacaatatcgatggttttcttatccattgctactctgacacatcagatgatacctatctttttggtgcaaagatgtcagctgaacaatatttatcagttagttatgataaacgaattgcaacattaaccggtcaagtttcaaataaacactatacatttggagtccaagcctatcgcacagtagagacgtccattgatagcagtggtcgaatactatctgatattgtacagcctaaattcccctcagaaaacccctacctcccctcttctactgtagaagtcaaaggtaagcttaatggctcgaaatacactgtctcctcaactgaacccgaagagccagaagcaaacgatttatggactaatacggttaccggtgttgtttcctcttatgacggcgaaaaatgggtttccagtgaccagaaaactgctgagttagttgaaaccacagcagcacaagttgacactaaactctccgactatgatagtcgtgtccaaaacattgagctcaataaccttttggtcaatcccctgaaatggaaaggcggaaatgtttctgcatttggtcgtaaatattatgctgatgttagttatgactcaactgttttaaacttaaatacaatcactattcctatccttattaatgctgtggatgcttcagactcaaatccaactgttgtggattacacttataacgaagcgtgggatatgatccctaaactcaaaaatgacgggtacaacattattttagaaccctaccccttcatcgcaaatggaacgatagctgaaaccgattgggcaccttctgatctagaccaatggttcgtagcatggaacaacatcctgcaagacttcgctaaaaaatgcgaacaatttaaattagacggtttatacattgcttcaaacctagttcatatggaagactcaacagaaaagtggaaatcagttattacaagcgttaggagtttattcagtggaaagatgctctaccgaacaaattattgggtaaccgctgattgggctcccgaaacgattgctgcctacaacaaaaagctgaataatcctctattcggactagtcgatattattgcaatagcggcttactttgaattaactgataatcgaaatccatctgtcgatcagctaattgatgctatttatagcgtaccgttatacggacgcggacaaaatatattcaaggaaatcaaagcattttatgataaatggaataagccgatcttctttggtgaacttggcatcccaccttacagtaactctcctgaacagccccataacgcattcggtgacctaggggaatacaatgaatcaattcaggcgaattggtttgaagcatgggttagagtttttcaagctcaagattggtggcaaggatattctgtatatgcaatttcagatgagaagtctgtttacaacgtaattgacaagaaagctgaatccattattagaggacaaacattaggtggtactaagggcagactgcagagtttagaagagagagtcgcgcacttagaagaattgctcaaatcaattacacaataagaaaggacggtgaatttagtttggattttcctcagctctataacgaccctaccctttctcaaaaaaggaagggttcaatcgatgacccttatttaagctatagtgaaactttaactgtttacaatggtcgagtcttacttacagaagtacctaaccgtgagtacagagtcgaggttagtggtgacagtaaagaatggcgagaaattgaagatggtgaattagaagacaactactttaaggttgattaccttatgggagttgtctttttcaatggttcaaatgaaggcaaatcacttacttttgcatatcaaggagaaggcgcatccttcttccctgcctcaagaatttggattaaacgacaaggaaatatggtcattgaaacgcttcaaggcttaattgatgatgctgaagatgccattattcgtatcaatgaacgtattgctgaatgtgaacgtgtcaccaagcgctgtattgaaataacaaattggtgcagacaagcaacatcagattatgagtatgtagttgagaatactaggaagatttacttgccgtttgtgtacacctatcaggatttattgaacacttatccttcccctcaaattggttggactgtcactgtaaaagaaacaggcattgaatatcgatgggatggtttcgactggataaatattagcgtgtcagataagtatgatggtttcaacattgtttctagctatgtagagccttacaacatcagatcagtatggttgagaacgaacaatgctcccaaaaagatgaggataaaaccatctgtagaaccccctgacggaagcatggtttggattagaaaaggataaggaggagtatatattgagcgacaatttaattcccgtaaacacaatgggctataaggacgaagaaacagagcaatggatacccattgatgccatagggttaaaatcaaataatattagatatactgcagacgatattcaagaggcttttgataaagcttctaaggatattaaaaacgtaataagcacagtcgattctggtttaacagatatcacaaacactattggagacatttcaaaaatccctgcagctggtgcaacaattgttgataaagtcttaaatgagtttatcagacgaagtgtcaatgttcaggattttggagctaagggtgatggtgttactgatgacactgaagctttcaaagctgcctttgccagcgggaagcgagaagtttttgtacccgcaggtatttatatggttcaaggattacatatcccttcttatgtcagactttacggtgttggatcaggatctattatcaagcttcacccaactgctaccggaacatcttgtgtgttaaccaatagcgactacacaaacggaaacgaatatatcttaattgaagacttagacctcgattggaatttagacaaaaaggacaacaccattacaaatggaacaaatgcaaactgtgtggggattgttaactctaaatttgttcgggttagaaacgtcaatgctcgtaatccaggtgtacacggttttgatgtaagctcccctgtttggaactcttcttctgatggagcagatcattatcagccaaatggtagcaaatatgtttggattgaaaattgtactgcaactaactatggtgatgatggcttcacaactcactattcagactacatcttcttcactaactgttacgcctatgacgctaatggatccgcacacagcaaaggagcttcaaattcaaacggttttgaaattgatgatggctctaaaaacgtatggcttgtgaactgttacagccgaaaaaattgcaggggttttgaagtcaaagctcacaatagagcacctgcagcaagaaacgtaaacttaataaactgctattccgaaaatgatatccgcgctttcgactttagacatattggcttccacctagcctccgaaaaaatctccacaagtgcatttgacattaatgtcgttaactgcactgcacaacatcctattttcagtgacctttatcaaggtttaaatcctcgcgcactagtcatttccgcttatagaaatgtcaacgtttcgaacttcaacgcaattggtgatccaacctatgattataaaaacactgcaatcatcaccacccaatataaaagcaaaaatatcaacctaagcaacatcactgtttcgggatttacaacagcgagtaacgatatctatgtaatcggtggagctcaaaaatcagataatgtaaacatctcgaatgtaaccattaaccaatctgctttagttggtattgctgtgggaagtaaagttggctcagtcaatatcaataacgttaacatgacgggatcaaacaaagcaggttcgataggtgtttactgcacgaattcacaagctaatattagcgctgcgatgtgtgaacaatacgctactcccagtaaaattgccggaaaaacctacacgtttatcccgaataatttcaagggcggtctacgtggggctacgacttctggctatgctaaaacaaatactagtgcagtattagcttcatcgggtgaacctcaagcacttggagatgccactttagttggagctactaccggaggatgcgttgcaaagggaacaagaaccaacgttttcggctcatcaggcggaagctctgtagatggatctcgtagcggtgtttacaactccaatgattctcatatcgaggggcaaaatgtatcacgtgaaatccacgcttctggaggtgtaaaacttggtgaaaatgatcgctatatggtggttggcggatatggcgctactccgtccagagcaaatattaaatggatgctaaactccatgaatggggatataacatcggcaggaaagatgaatggcggagccacctttagtgattacgctgagtattttgaaagtcttgacggaaaagcaattccgacagggacaattgtcactcttgaaggagctaaaattcgcccggcgagaaaaggtgaagatgtacacggagtaatctctgaaactgcaggaactattctaggaggagctgatattcactggcaaggtagatatttaaagaatgagtttggtggatacatatatgaagatgtggtcaacccagaaaccggtgatgttaagaagctgcctaaagtaaaccctgagtggattgaaaaaatagattacgtccctcgtgaagaacgtcctgaatggaatatagtaggattgcttggacaggtttatgtgaaagtggacagtactgtttctgtgggagatcgaattgaaggtaattatggaatcggcacaaaatcagaagacaggttttactcttggaaggctatggagattgtaactccatattcagacaagctcggttacggcattgccatctgcttaattaagtaacccttaaaattaaaggaggtggttatgttctagttaaaatataaattttattcaatttacggcattcaaaaacagagataacaagagcatacgtgagataaagagagatagggatttgtccccttctctcttttttgtgctcaaatttaatttaggagagatgtttaatatggctattcaagcgagacaaatgttagtatcaccagacaaatattcaatcaaatgtccatatgcattatctgcttcattcatcacttttcacaatacatacaacgacgcaccagcgcaaaatgaagttagttatatgatcggtaacaataatgaagtttcttttcactttgctgtagatgataaagaggttgtccaagggattcctacaaatcgtaatgcatggcatacgggtgatggatcaggtgtgaattcaggaaaccggacttccatcggtgtagaagtttgctactctaaatcaggcggagagcgctataaaaaagctgaagcgttggctattaagtttattgcacaactccttaaagaacgtggctggggcatagatcgagttaaaaagcatcaagactggtctggcaagtattgcccacatcgagttcttgatgaaggacgttggaatgctgttaaagcttctattgctgctgaattgaaagcactcggcgggaaaacttcttcctcatcttcaaagccaacaaaagtcgttaaaacaaatggctcttatgttaagaacacagttatcgcagacagtcttaatgtgagaactcagcgcaatgcgaactcctctattgtacttgcccttcctaaaggctccactgtccaataccaaaaaggatcaactcaaaatggttggggttatatcaaatatacaaactccaaaggcgctacatacagcggatatgtaaatgtgaaatacattaaaagtgatgctgagcttggaaaatcaaccccaaagcctaaacccacttctaagcctgatagcagtggaatcaaatctgtaggcaagattaaagttgtcggagtaaaaagcgctgctatcgtaatggacagacctgataaaaacaaagcgaagaatctcggcactgtggagctaggtgataccgtcagcatttctggctcagtgaaagggttaaacaatgctaagggttactgggaagttatctacaaaggtaaacgaggctacatctcaggacaatttggctcaaaaatctaaatatatttaaatatctttgagaatgattgtagctcaaagtgtatcaatgattatttaggaggtgatgtgacattacctcctattttttatggaggatgattgcattgtggctgaaaaagaaaactatgaagttttaaagaccgaggtcgctcatataaaagaacgtcttaaagaacaagcagaagatagaaaaatcatgttggaaacacaaaaaacaacaagtgaatcgctcattaggcttaccactgttgttgagaatcaggaaaaaaaccttgttgaaacaaaaaatttgttcaccactgagatagctggactaagaaatgagtttcagcaagttaatcagtcgcaaacaaaatggcttcaaaacttattagaaggaacattcggcaagacattaaagattttagttctaattattctcttactgcttggtgcagagatcgctggtgttgatatcaccaaattagctaatttataaggagacgatttaatgactaaaattaactggaaagtaagacttaaaaagaaaacattcctggttgcaatcttctctgcaactcttttgtttgcacaagcaattgcatctgcatttggatacgacatttctgtgtttagcgatgatcttactgagaaatttaatgctttgcttacatttctaactgcaatgggggttgtagtggatccaaccactacaggtatctcagacagcgatcaagccatggaatacacagagccaaaataacttggggagtttatctccccctttttttcattttcaagaagaaaggaatgattgttgattatgcaaataggatctggatatatcggaagtccaatgcttgagaagtcagaatctaaccatgaagtaatcccctccccacctgcaacctggacgattaaatattctttctataagttcagcttttcgaatgatcagaaatgccacgtatcaatcaatggtggagatcctatctatttaagggctggacaaggctttcaaatggacgctcacgattcacctatcacaagcttcaaaatttctgagtcaggaattacatataactttttgggggcgcataaatgagttttttcaatccaatggttaatgtctcaattgtcactgggaagtctgcttatgaaatcgcagtggacaatggtttttcaggaactgtagaggaatggttagcttcactaaaaggtgaaaaaggcaacactggagctactggcgctaagggagacaaaggtgatactggtgcaaccggtgctaaaggagctactggtgctgccggtaaagatggaaaatcagcatatgaattagccgttcaacaaggcttcactggaacattagatgagtggcttgcttctctaaaagcaacagcaaactgatcatatacccttctctaacgaggagggtatttttttcgtttcgttcataatcgaattattgatttgtttttaattttcactcaaattccctttacatttctttcctccaatgcaactatataataaaatggatttgaaaggggtttaggacttggagaacgaaaaggtcattccttatgatttagtagcaacaaagatgaatcattggtatgtggctattaaaaagaattgggtcggtagagcagaagaaatgcgtaaagaagttatgcaggaaataaaaattatggaagaaaaccaagatgttttactatactactccctacttgagtttagacataagctaatgttggcatatatgtatcctaacgctataaaagacattgagaaaaactatggtgagttaaaagcatacgaaggccatgaaaacttaactggaatgctcgaatattactattattttttcatgggcatgttctattttagacaaaaggagttggcattctcccttaatcactatagacaagctgagagatatttggattcaattgagagcgaagatattgaagttgaaaaagctgaattttattttaaattgtcagaagtgtattaccacatgaaacagacttatttttcaatgaattatgccatgagggcttacgatatatttaaaaagcaacctgctattgacgggagccctacatacggggtacaaaaggtacgctgtcaattcgtcatatttggtaatttattggacagtatgaagtttgatgaagctttaaagcaagcatacaaagcgtatcaggaagcagtagagctaaacaaaagtgaaaagaatcgtgggcatttgatgcgttcagcactgtttaatattggattatgttataatcaaatggaagaacttgataaagcattttttcactttaataagtcacttcaaatcattgagccggaaaatcatgattacgctgctaaaacattatttgttatctccttcttaaagggaaggcaaaatgacattgaaaacgcaaaaaaattttatgaacaggccaaacagttggctgaacggcataacaatgaaatggtacttgaaaagttaaaaatggttaaaggacttttcttggactatgatttagacttagttaggaaaacattcgagttcttcaaagaaagaagtatataccctgacatggaaagctatggtgtctctgtagcagattttctcactggaaaacaggatgcttggggtgcagttgaattttatcgtttggcaaatgaagcaagaagacaaatcaaaaggggagaagcaatatgaaaactaaactatttatctgtgcagttctattattcggcgttgccggaacagtgggtgcttcctatctccaacaacaaaatgatacgttcaaggttgctgaaagagccgaaacgtaaaaaactaatgactttgtaaggagaacagagggagctgctctctgttctcatgatttatgtccacccgtcaaacctgctctatgcaaagctgtgcctccaggtgtataagaaacagctcgtaagatcgctttagatccgtatttgtttcttatcccgtccataacgaatccaagctttcttctcttctcattatctttttcaaacagacttaattgttgatttacatcatcctcaatattggataaggtaactgaaacacttcgtaccgttttgcctgtatagaatttatcaaacaacatcaagcaatatcgataaatatccattgtgatatttgtaggcaaatcaatcgttttagctctgtgaaagccgccgctgaactcatctttactgtaaccaatacccaagctaattgtgcgccctactttgttatgtgttcgtgctcttcgtgcaacctcttcacaaatctccaagagaaccgccttgatatcctctttcttcgtatagtctctaagtaatatctgacttttcccgtagcttatttgcccttgcatcaaaggagctccaatttcagaaaggtcaattccatgtgcatgataataaagctgattgcccataatgccgaatcgtttttcaagtagctctaatggatatttagctaattgaccaacagttgaaatccccatccggtttaaattcctctccatcctccctcctattccccacatttcagataacggatgaacacaccaaagcttatttggaacatcttcatatctccaccgtgcaatcccagtctttgttttcttactctctaaatcaagagctaacttactcagcaacatattgtcaccaataccaacagtacaaactaagccaaactctctcttcatactgctctgaattgcttctgccatgacttcaggattttcttttcctgcatctaaaaaagattcatcaattgagtacgtgtgcacacatgtttcaggaacgaacctgtaaaacaatttagtgatttcagttgaaactctgatgaaaagtttcatttgcgggtttactatatgaatttttggatcatctggaatctcaaataaccgggagccagtcttgattccataatcttttttaagtgcaggagacgctgctaagacaacacttccctgtctatccgtgtttccgactacagcgagataacatgtcattggattcaatcccattgttacagctgaaaccgaagcataaaaggatttcatatctacacaaagtatatttttacgtggaaactgtgagtaatcaatcattgtaagcaactcctatgatgtcattcatggtgatgtatacggtttgatcatgatgatcttttacgtgtaatttgtgttgttcgtaattgagatattgaactgtaccgattaaatcctcagcaaccccttctttaaagagcttaaactttagttctttattcaacgccattgcttcagaaaccaggatgtcaatctcctcaatttgttgctcatctaaagatggcttctccattttcgaaacatctaacaagtcctgttttaattgcgttaaatgttctggaagcatcatggaagtccatttgatcgcccctcgatctctaagcattttgaatcactcctttattgatctaatattaacagaacaaatgttctttattcaatataaataagaacaatagttcgatgtaattgttggaaatgactattcagcaagtatccactaagctttatgggctgctctagtcgatacttgagttcagtttcaagaaatccgcaggaaaaagtaaaaacagccgccagaagaaaatgcggctgtgtgtctttatttgtctttctcctttttttcattcggcagctggatggaaggcgtcacacctgatccgccgcttccgttataaaactgcggcacctctccttgaatcgctttaatggagaccggaatattatttgtcacgactgatgttttactggcaaacggaataatgaccttcactttaatttccacaaaaatactgatatcgatcagggcattgttaatgccgtacggctttatttttgttttcacatcagttaacgcatcaccgatcaggttaaagcgcacggggattttcggccccagatttccgagaatgctgtttcccgtgacctgccctaaagggatgttaatcataatttcatcggccgttttcgcgcctttttccgtttcatgctgcttattgttcgactccgcttccttcaaatgagcctgaagctgctttgtcactttcgccttcatactgttgaccatttgtgtattaaaatccatcgttgtgacttttccgttttcatccgttttcatatcgaccatatctttcacattgtcgctgtgagacatgtattcttcaatggattccgtaatgacctctgtcgccacccgtttggtttccatttctcctatgttcatcagcaccggtttgattgaggagttgatcatccagaggctgatgaccgtcgatatgataaaaaaagcaaacgacagaagcaacacataccgaaaaggcaaaggccctctcttgcgaagagcgctccggtatctaggcaagaaaaatccccccttacatatcacaatgtatgcttgtaagggggacatagtaatttattttcacacttaaaaactccggcacaaagtattgcttttctttctgatcacgcaaatgacgggctatttttatagcctgcttattttcgtttttctaatcctttttctttttatgctttcttttgaaattcccttataaatttgatgtgaattttccatttcattgcttagctcttttgtgttttcttccatcataggaattcttgtatttacaatcttagatagttcctggttaaattgtttcatcagtttagcttggtctttaagatttacggcaatgtcagtatatagttctatttcattaggatttaccccatcaatgacagctttagcataactcctagcagcttcatgtgggtctgcatatgtaatgcttgagccattatgaattagcaaaatttctttcttcatgataaatttcctctcttgttgaaaatcttaatatatcttataacacaaatttcaaaaagaaaagtactacattataacttgtctattgtcaataaggctccaataatcacagacatatatttggaattagtgtataatgattcctgtacattaaagcatgctcactcaagggagtcttgctcatcccctacgaaagggggtgatgcttatgtcaacatttcaggcattaatgttaatgcttgcattcgggtcgtttataatcgccctgttgacgtatataaataaaaaatagacctcccttgagcctggaaacctgaagggttaggcctatcatgaacaactgctgagcaagccctttgatgggcagctttttgtacagagccggggtgctaccaacaccctggtctttttattttatgcatttccacaaatcaaatgcaaaaaataattatataactgtatcatctacactaattataaccacataaaaatggtatttgcaatactattgctttatggattaaaccactttcactttgcctaaggacacttatgctgctacatcatgcaattgcaatacttttgcttaactgtttaataaatcatcatctagctcaatagataaaataccatcgtcttcatctgttgtctcttcaataaacagactttgaatgaagtcagagaaagaatttgcgaccaaaaatgtgtcttttattccatttgtcaattcatgatcccaaaaataaacttttcctgttgcttctcctttcacaccaagacaaatttgatctcctccgtcaccatcagcaatcggtataatccagtccggcatttgttctgaaagatcctcttttaatttgataatattagcatcattgttattaagaccgtagaaatatcccaaccggagattaccgttatctgctagtggattgtcctctaaaacagggaaaaacacattatcttcctctatccagcattccccgtataaattgagaaactctttatattcatctgttatgtcgaaagaattttcgtcctcaaactttttaaggacttgatgagaatttatgttcttatcaagtcttatatctaaataaaattcactcatttttttcttgattgcctgtatacccattaaaatcctcctcttaaatcagatgccgaacctacgtgaggtatattaccatgtaaatccatagggattaattggatggtgttattgtctaaatgatgcggtgttaatctaactacttctttcagccatttttcagcttctttttgggttttaaagcctttcattttttgaatacgtttataaactgctggaaaatcctttttagtacctttcagttctcctgatttaaacttaatcgtccctttgctccatggtgtaaaaaccggtctgccatctataaaagtgacgggttctcctttagtaactgcattaacgtcaggtctatctgagtgccatttaccgttaccaggagtcccttcccatctcccatgatttctaggcaaccttgttctaggattggcggactttattaactgaagcagacgatcctttaaattctcaccgttaactacattataaggaactcctccagccggaacaacatcgtaacgtggattataaggcaataaatcagcaattgagacatctttcagtttttggcctgctttactgactttagaggtgacttttcctgctacgtcagcttttgtaagagaaccggctccctttgtgcctactacagaggtaactaccgtacctatcgcatatgtcacccatcttgatctggagtaagcatctccatttaccatatctttttgatacgattcctcaatagctgttgaaatggaattatacgtgttaatcggatgagcaactgcccctatgataccttcaacaacttcatcaggcttgctgatcagctgccataaacctgttaccgtgtctttcccgacatcatataaaccaacgccggctccttttaaaatatcccaagtcacttctccggcttcttccatctgttttgcttgttcaagctgcatcacatattgttgttgggaaggttcaaggttttcatagccgatcttcttcgcgatttctaaatattcatccggatcggtcacaccgtcagcgagctttttcttcagatccttgatttcccgctctttcgcttcttcctttttaatcgtcaaataagcatccgaatgtcttgcaatctcgccttttttcttatgtatgtcactttctctgtacgccttggcgttatagtgaagtggtgttgcgtttttccctttacccgtggcattttgaagctgttgaaagtcggcttggatgaaatgctcgttcgcttcggtttctgcatattccttcgttagatcatgatcgagctttccgagcttgtgtatggtattgtcccgtttcttatctgctgaatccagcttttgatcgacatcctctgtagagaaaacatcaagatgaacaatatcacttatctcattaagaatatccctcatttcattccgttgctcttgcatgatggcttttgacttattcttcgcatgaatcaactcatgctctaaaaatgactcttccacaaacgaatcggctaatccggcatcagctacttttcctgaaatactgttaagaaaagcaatcttcatatcgatcagatcaagccagctgtctgtaacaccagcgtgatcttggaagaatgctttaatgttatcagcacctttacctgaaaactcgctgtcatctaaatcagccattccttgaaatgcttttctgagattgataaattgttctctaatctgatcgtattcttttgctcgcttttccgctgctgagattaacgaggatgcttcaaataccttcatatctgtctccttcccactcaatcttatctaaattttaccacataaaattacatgtaaggagagcttcttccttttgtcgaaggtctctttcttaggagatttgaactttaacaaaatcttaaaataggcttaattcagttgataaaaaatggaaaaggtgatactatcctcgcggaaggaggtattaattgtaaaatatattatttatttacatcttagatactcatagcaggtttaaacagaagaaaaaggagtgtaaaccattatgaagtatgtgtcaaaaagcatttggttagttgtaatagctctctctttattattctcttgctatcccctccatgatgtaaaggcaacggcaaacaaagaaatcactgataataatgcaactggcattgacctaaacaaacgtatctcaacagtaaacgaaaaaccgcaaaacaccgattcctctaaaagagaattagctggatcagaaagtaagttgcaaaaaattgctaaggaacaaggaatggatgttgaaagttcatatcagacttatatagcttatgacaaagatggtaatcagacatcatctggacaagtcacctctgaaaaccaacggaaaactgttgagaaaaaagcaaaaagtattatctatttcagtcacacttttttaggtggaaaagttaataaagtgatgcacggagttgaaatttcaaaaatagtagggattcctcctgcgtcagcagaagtacaccagggtttatgcaaaagtggttattataataaacagtttacttgcccccatactattagaaagacctttgtagggcctcaagtgaaaaagggatcggaagttcatcaatttattaatgtaaacaaaacaacattttggaagtatactggcggcgcaattgctacttgggcagggaaaaaaccaactgttagaacgatatcctggactgaaggattatacctaacgaatatgaagggaatgtttttcccctccaattacacagataagcaatcaggattaaatatattagctccacctaatgcatttattaaatgggtgcctagcgataaaagagtaaaatggggaactacagaacgcaaagcatataggaaatggtatgataaaaaatacggcaaaaaaacttgggtgaaatttgagattcatcatcaactacctagagagtacggtggaggaaatcagacaagcaatttaattcctatcgatgtgaattttcacaggaaagaagtaaatccatggtgggcttcttatacaaaaaagaagtaaaattgtagatgaacgtagatgaagactcctatgcggagtctttttattctgaaaccagtttataatactctcggatattcggattcacttcccaatatttcgttccattggaagaaactaacatatcaaaccatatttcaaaattcgaatctaagttaatcgcatcttcaatatcatcaattgagtctagatatagcatataacctaatccattttttgatttgtttgtgtctatgacatatcttccatcaaaatgatatccaattaaaacgtatccctctgggaaatcttgaacctcattatattcaatgattccctctaagctaagtatttcaatcccatcaaacatttccatcccattgtgctgtaacaaaaactctttatagtcattagggaaggtaacacctagcttctgttctatatcgctaatttcttgaggactagcaggatctttgaaatgaaaagtagcatcttccatgacataccctccatgatgaaacatagggaatgttccgtatttagaaacagcttcctttattccattaagagtcatttgaattaacttcccttcttccatataactttccctcctctaaggtttagaccactaaattttaccacacaactttatttgagtgttttaaaatgacaaaatcaaatttacaatctttggttttatatttataattaggaaggtttgtccgatatagagacagaacaaacaaatttgggggaattacattgaagaaatggttgttaggtattggcgcattatctctaagcttttctttggctgcatgtgggtctgattctgcttctacagataaaacagattcagataaggctaaaacaacgcaacaagaagaaaaggatacaaaagagacaaagacagactctcaatcaaacgacaaaagcaataatgacaagaatgaaaaagccgaaaatgcttcaaagaaggattcgtcggataaaaagacatctgacaataagaaaaagctagtcgatgtaacacttaacagaacggttgatggagacacgattaaagttaactataaaggcgaagtcaaaacagttcgttatttgcttgttgacactcctgaaactaagaaaccaaactcttgcgtacaaccatatggtgaggatgcttcagcaagaaataaacagctagttaacgagggcaagcttcaactggagtttgataaaggagatcgcacagataagtatggcagaatgttggcttacgtttacgcagatggcaaatcagtacaagaaacactgcttaaagaaggattagcacgagtagcttatgtatatgagccaaacacgaagtatttagacacgtataagaaagatgagcaagctgcgaaagataaagacttgaagatttggagtaagaatggatatgcgactgataaaggatttaatggctgcgcaacgaaaccgaagaaatcagtaagtgtatctaagccggttcaaaagtcagttacaacacaccaatccgagacacataaatcgaaccctagcaattcaaattcaagcagttcagcatcaagcagctcttctaactctgcacaagcctccccttctgctggaggaacagaacactttgcaaactgcacagagctgagaaagaaatacccgcatggcgtaccaagcactcaccctgcttatacatctaagatggatcgcgataatgacaactttgcatgtgagaagaattaatccatcggaagccctctgaggcttctttttttatttgggtatattctatctaaataaaaaccacagagctctgtgagggactctgtggtctatagtggctgttaaacccctatgatacatcaattaggatactttaaattagattaataagcaagctgatctaaaatgtttcgttaaaatgaggattttataaagaaattccaatgcacatgatataatctaactacacttacaataagaagaaaggatgaaatacttggcgttacacgaaaattcaagaatagcagtttattcaagaaaatccagagaagacagagattcagaagatacactcgccaaacatagaaatgagctagaatatctcataaaaagagagaactttaaaaatgttcagtggtttgaagaagttgtttcaggtgagactattgatgagcgaccaatgttctcattattattgccaagaatcgaaaatggtgagtttgatgcagtttgtgctgtagcaatggacaggctctctagggggtcacaaattgattcaggacgtatacttgaagcatttaagcagagtggaacattgtttattacaccaaaaaaaacctatgatttatcaattgaaggcgacgaaatgctttctgagtttgaatcaataattgctcgaagtgaatatagagcaataaaacgaagaacgattaacggaaagaaaaatgccacaagagaaggcagactgcattcagggtctgttccatacggttataagtgggacaagaatctcaaagctgcagtagttgttgaggaaaagaaaaaaatatatagaatgatgattaaatggttcttagaagaggaatattcttgcacagtaattgctgagatgttaaacgaactgaaagtcccttccccatccggccgttccatttggtacggagaagttgtttcagaaattctgtccaacgattttcataggggttatgtatggtttggtaaatacaagaaaagcaaaagcaacaacagtattgttcaaaataaaaatctagatgaagtattaattgcaaaaggtcatcatgaaaccatgaaaaccgatgaagaacatgccctaatcctgaatagaatagaaaaacttagaacatataaagtggctggaagacgtttaaatatgaatacccacaggctttctggtattgttagatgtccttattgtcataaagcacaagctatagaacaacccaaaggcagaagaaaacacgttagaaagtgtttacgaaaatctgctgaaagaacaaaagaatgcgaagaaacaaaaggaattcatgaagaagtattgttccagtcaattatgaaggaaataaaaaaatacaatgaagctctcttctcccctactgagcaagatgttaatgatgactcttatacaactcagcttattggtttaagagaaaaagctgttaaaaaggcaaagggaagaatagaacgcataaaggaaatgtacttagatggggacatcagtaaaacagagtacaaagaaaagctgaaaatttcacaagagacacttcaaaaagctgaaaatgatttagcagaattaattgcatctactgagtttcaaaatgctcttagcgctgagacaaaaaaagaaaaatggagtcatcataaagtgcaggagatgattgagtctactgaggggatgtctaactctgaaataaacttaatactaaagatgctcattagtcatgtaacgtatacggtcgaggatttgggagatggtacgaagaatttgaatatcaaggtctactataactaggtttatgtcgtactcaatcaataattcttacgacagatccggttacgacaggcggaaaaaaggatacgagcttgccgaagaaaaatgacagcagaatgacaagcagacccgatgccaaaatgcttccgtaaatggctgaaatcccgtactccttaccgatggaaataatcggcgctaccgcggtgaacgtacagccgagcacaacaggcaagccgatgccgaaacatttattcctccatacttgaagcagcgtagccgccccgcacataaaaatgtcaattgatacgagatatgtcagctgttctgcgttcagtcccagtgccgctcctacaattaaaggaacgacgacggcgccggcatacatggcaagcacatgctggataccgagggaaagtgttttggcatagccgtttttcatgaacggacctcctgtacaaatgtcacttttccgtcttcaagcgattgaattctcgccagtgattcgacccggaatcctttttttaccagctcgtctcttcccggctgaaatgacttttcaatgacgattccgatcccgcaaaccgctgcgcctgcttgttttacgatggacaaaagcccctctgccgcctgtccgttcgctaaaaagtcgtcaatgattaacacgcggtcttctttcgagagatgatttccggagattgcaatctgactttctgtttttttcgtgaaagaatagacggacgccgtcagcagatcatccgttaacgtgagagacttcctttttctcgcaaagatgacgggaacgccgagttcaaggccggccattaccgcaggggcaatgcccgaagattcaattgtgacgattttggttatctcgtctttttcaaaacgccgcgcaaattcccggccgatctgctgcatgagaaccggatcaatttgatggtttaaaaaagaatccactttcagcacttgatcagaaagaacgattccgtcttctgctatttttcgttttaatgcttccacaatgattacccccgcttataaaaaataaaaaaagcattgcccgctctccaaaaaaagagcaagcaatgccgaatgatctacacgtaacggccgaataaagccgttccattgctcactcatagtcggacatttacggtgaccggtagaaacttgcgtgccatatccacgcgattatatgagtgttcgtatgatattaatcaaattataacaagatacacttcttttgcatagtgaaatttgaatatttccgaacttttacaaagaattagttttcgattattcgtctttttagaatttttagaaaaacacccggtgtatgccgggcgtttcgtttataaatataaatttgaatatttgccgacgagatactcaatgagatattgaacgtttaattcttctcccgttgcatcttttatgatgtcaagcggcattttgcgtcttccgtgctgatgaaccttttctgtcagccattgtttgatcggctcaaagtcgccccgttctattaattgatcaaattcaggcagatcctcaagcatggtatgcttcagctgtgccgcatacatatatccgagcgcataggaagggaaatagccgaaatcgccgcccgcccaatgtacgtcctgcaaaatgccttttgcgtcagatggcggcgtaatgcctaaataatcatgatatttttgattccacaatgcaggcagttcttccactgtcacttcattgctgaaaatcgctttttcaatttcataacggataataatatgaagcggatatgtcagctcatcggcttcaattcggataaaggtcggtttcgcctcatttacggcgcgtacaaagtcctctcttttcacatcttgaaattgatcaggcgaagcctcaaccattttttcataataggcggtccagaaatgttgatttctggcgataaagttttcataaaataacgattgggattcatgaattcccatggatgcaccgtcagataagttcgttccgctcagcgcttcgtcaatattctgctcgtagatcgcatgcccgcattcatgaatcgttccgaaaatcgccgtgcggaaatcgttttcgtcatatctggtcgtcacccgcacatcgccgcggttgattgtcgtcgcaaacggatgcaccgtctcgtccaggcggccgccgtcaaaatcatacccgaactcttttaagaaatacaaggagaggtctctttgttgttctttcggaaacgttttcgttataaaggaagtgtccggtttattgccggattccgtcacttttttgataagcggaatgatcgcttccttcaattcagaaaacagctgatccagcacctttaccgtaacacccggttcgaaaatatcgagcaatgcgttgtatggatgatcttcatagccccagtaagaaataaaccgcttattaaaatcaatcagcttctcaaggtacggagcaaacatagagaaatcagaggccgcctttgcatcctcccaagccgtttccgctttcgatgttaaaatgacatattctttatactcatcttcaggaatttttttattatgatcataatcttttttcgcaagttccgccgctttcactgtatcttcagagagctcttctgcatgcacgagaaggatgtcgatcagctctttcatccggtcggatgtctggatttgaaaaacgtcagccgacagctgtccgatgctttccgcccggtcatcagagccttttttcggggctcccgttcttaagtcccaatgcatgagcgcaatagcttcttcatagtgggatactctttttaacagattaaaaaactctttttcatatgtatgtacatccatatccgttcccctcccttttcactatcaattacaggctaatggaacgccgttataaagtcaacttcccggattaaaaaaagccgcaggataagattcctgcagctcttgtttttatacgattttcggtgtaacaggcaagacctttttgacttcggccaggacccgttcactttctccgcccgcataaatggatatggttccgctgtcctgattagaacggatgaggcggccgattccctgccggactctcaaaagcatgtacggcagatcaacttcctcaaacggatcttttttcgctccgttccgctttgcggtaaacacaggatcatgaggcggatacggcaatgcccaaatggtcacattccggagcgagtcaccgggaatgtcaagaccttcccataagtggacggaacaaagcacggattcttcatcccgctggaatttttcgaccagactgctgatctcttcgtcaccttcgtagtaaatcggatacggcagctcccacgcggcagcctgttctttaaattccttcatgtcttcaaaggaagggaaaagaacgagggtgcgtccttcattctccttaatggtttcaatcgtttcgactgttttctgctcagacgtcatgtcaccgtgaagcgcaacagacatttgctcctcgtaatcgtacggagattcaacggtaaatgataaaggatcacggattccgagactgtcagcgatataatcaaatgaaccgccctcagaaagagtggccgatgagaagatataaggtatctttttagaaaagaccttttctcccaaaacttcggctacagttctcggcataacgacaaacgttgagtctgtatcccgcgtttcaagccagctgatggcatccttttgatacagcgacagcgaatatgccatttgttcgacgtattcttctacaactgacagctcgtacttatcaatcgtatacatttccgattcaaatacgagcgcctcgccgattttatcgagcagacggcacagttcgtcagccgcacgcttaacacgctggtcgttttggatgtccaatcggtgagagccggcgatttccttcgattcctctgacagcacatagaaaaactcatcgtttgcggcaagggcatcttcaatcagttcggcgaattcctctctgatgtcattttgaagcagacgctctaaaaacagctcaagcgtcgactgcttcacacgatacgttaacgctttttgcgcggcgaattccagcagatgtccttcatcaaacacgacggcgctgtgatccggcaaaagcggcagctgcccttcccttttgcgtgattcttccgtccatacatgctccatgtagaaatcatgggagcaaacaatcagatccgttgattttctgtaatgatctcttgaaagtgttaaaccgcatctatgtctcatatcacatgttaaacaatcttggaaggaatcatagctgacgcctgcccactcttcatttgtcaaatcagcgtactgtttgcggtcgccgtacggataaaagcgctgcatcgcttgtgattcgtgtacgaatgaaggcagcgactcataaagatccagccacttttcatcatcagaacgctgcatcgttttctccagctttttcagacagagatactgctcatgggatttggacagccgtgtatcaatctgcagatccaaatgttctgtcagcttggaaatgtcgccttcttttttgacaagctgttcaattaacgtttcatcggcgcatgcgataatggccggtttacccgtatatcttgcatagctgatggcaaacagcagatacaccagcgttttccccgtaccgactcctgcctcagcgaacatgacctttttctctttaaatgcccgttcaagctgaaacgccataaatacctgctcatcccgaaggtcaaagcctttctcgggaaggatatcgtaaaacacgtcaccaatccaattgttcaattcttcgtaaaaattcttttcttttgttaaagcaaaaggcaaacgtgatgttgtcacccaactccaacccctaactattcggcattcagaccatctataatatcatttaacccttttcaatacaacaaaaaaacttggcctcgccaagtttttgtcattatcatttccggttaatgatatgtgtacataggaacggatggtctgttgaatgtgtatgttttaccgcattttcaagttcttcctgtgcgtgtgtcatgacggaaggaccgaacttagctccggcttcctccagccggaaagcagttgcgtctaacgccttttgtattttactgaagtgctcgctgttcagcataaaataagatcacctctcaaatagaaataatcatcattctatgccgatgcttcactttctatacatgccatcctgaatgatccgcacctgacctgcacaaactacaacagatattcgatcgaatatccatcttcacaaaattattctatccgggagtgatggttacatgagttataaagatcgattagatcagcattctgaattgtttcatcacaattggacgcggccgaaacgctctaaatcgcaggtgaacggccacaccgaaatgtcccagaccaacattattttacggagcaacgcaaaagcgcaccgctggtaatggcagaataaaacgtaaagatgccggagaagacgctgtatcaggcgtcttctctttgttgcggctttttccgctgcggccgcactttagcccagtactgataataatccgttttgataaaaccgttaaagagcttccgtttttttgttgcttttcttccgtagacctcttcaaattgttcatttgacgttaacatgtagacagaccatgtatcaagagattcaaatgcccggcccatttctttatacatctgctcgacttgctttttttcgccgagccgttcgccgtacggagggtttccgacgataacgccgaattcgagtttcgtcgtaaaatcctgcactcgcatctgcttgcattcgatcaggtccccaagtcccgcttcttctgcgttttctttggcgatgtttaccatccggtgatccacgtcactggcaaaaatctgcagcggctgatcatagttcgccttttcttccacttcaaggcgcgccttgtcccacagttcttttccgatccattcccagtcttctgaagcaaaatcacggttaaaacccggagcaatgttttgcccgattaaagcggcttcgatggcgatcgtgccggaaccgcagaacggatcgacgaacggacggtcaggcgtccagttggttaacagaattaacgcggcagcgagcgtctctttaatcggagctccgccctgatcaaccctgtatccccgtttgtgaaggcctgttcctgatgaatccagtgtaagtacggctttatcttttaaaagggaaatctccaccttatactcgggtcccgtttcttcaatccattcattttgttttcctgattgaagtttcagctttcccgctatcgcctttttgacgatccgctggcagtcaggcacactggcaagcactgatttcacggactttccgataacggggaactttgcgttttctggaatgtacgcgcgccagtcaatcgcttttgttttttcaaacagctcatcaaacgtttttgcctgaaactcggcgacctgtactttgatgcggtcagccgtccgcagccataagttagcgcggcagatcgcaagcgcatctccttcaaaaatgacttttccgttgtctactttgcattcataacctaaatcacgcacttctttggcgacgatcgcttcaattcccatcggcgccgtcgctattagtgtgtacttcttcatcgtatcaccctgtctcttttaagctttcgtttcattcaagataaaagctcccctttaaaggagagctctaatttgtcatatcaataatgtttaacgttctgtaagccatgttttgttccgtcgtactgcaatcggctcatcacctcgtactcaggcggcaatcatctatctacagaaagtattctgtccttctatctgttcagttccttcaagaaggttcccctaccaaaatttgggtttctcgctcgaggggtttaccgcgttccactctcaacatttctgatgagacttcgtcactgtggcactttcaaggatactcagccatatccggagacgtaggcttttttcctgccgtcagcctatcaaggctgccctagcttatttcttcgctaggcacgaacactacgggcatctcagcaccgtgcgagcatggactttcctctacagattcaaagacctgcagcgattacccgaacgttaagaacacttgttcattataaagcaacttgtctcatttgacaagtgcatctgccttattcgtcataaagtttgctgccgaatacatgtttctcaaggttggacagccttttcagaatatcaaagttggtcgtattggactgcaccggctgttttttgctagcttcttcaagctgttttttcagctgcagattttcctgctgcagttcttcaatttcttgatgaaaggtttcataatccttaataatcatatctaaaaatttgtcaacgtcttcttgtctgtaacctctaacgcctgttttaaattctttttccaaaatgtctttcgcagaaagctttactttatcagcaagcatctttttcacctcatatcgtgaatcatcatgttatattttattcagaaacacgtcccgttgtcaaatattctctgacgtgttatgtaaagaaatcttcttcctcaacggcggcacggagatcatccatcgtaatcgaataaatcggatatccgtctgtttcacggcgtttttctgcctgctgcagcatatatttcggcgatccttccacctccggatcatataaaagcaaaagcgcatctgacttttcaataaagaacgcgtttttctgccggaattggagcggactttcgtacggccgatgcgtcaggctctcctcataatctgcctgagcaagcaccgcttcatacatttctttattcggctccttccacttttcctcctggccgtagaaaggcgtgataacggcaacctttaattccggatactcttctctgagatcgtacgccgtttctgccgcccaaagctcagtccccagctgtccggatatgagaatccattccaagccttcgtcaataaagcttctgagtctggtttctatcgccttttttatataaacaagcgcccggtcatcctgtttaaagataccgagctcaaacggcttgtaccccgttacggctaatactttcaattaatcacctgcttaaaaaatggggctccccatcgggccccattttgatttgctgatatcctaaccgatcttgcttaagcgttcaatactaatgatcgcagcaagggcttccgcactgaaaatgctggtgagttgtcgggtcaacatttgaaaaagtgtgcggatagtaatgaacgtgctcaaagttgtggtgatttacgttagttgtatgttgcggatgaatatgcggcacaaccgtgttagaaaagcaatggtgttcacagcaatgagtcggatggacaatcggcggcatcacgtttggtctgcaacaatgatgatgaaacatgctaaatcccctctccattaacttttattacactgttaggttatgaagaaaagagggtgcatgttctaattcaatcacccaatttaaaagtgtgtcagcaaactgtctttaaaattcgaaaatacaaacgcaatcaaaaaaaccacgacaaagaacaagtaaaaaacacctttatacataccaactctcccctataaataactaacgctattttacaagatgcggcaccattctacaacaaaatcgatgcggattcagaaaaaaatatttttggcgaaacagctcggcttttgcgctttcccgggcaatatttcaagaggaatatttcctcttgagccgggcaattctcacatggagcttctcggcttctttttccgatatttccccgtcttctgccgcctgctgcgcggcctgcagagcttttttgtaatcttttgcatggtgctcaaaatagatcgccagctcaaccgctgattggtgtctgcatgtgtgaagatcagagtccgtcagtttctcccaaaggggcacggcgtcttgcctgcggttttgttttttataaagcatcgctaagtcaaaaagggcccgatccgaatcttcaaagtctttgccttgcagcgcttccagctgcaaaacggcgcgatcggtttctttatgagcgataaaccatttcgccatggcgtatgcttcctgacgttctgacgtctgatcagaagatgcaaaaatcttttttgacatatggatgtaaagagcgatgagggaaagcacatcttgttcattatgcgagagcactccctttaaaagagccgggtcctccgcctttaaaaattgaaaatacagcatcggcgccaaataaccaggggtgtcttcgtcccttttaaaagcaagctcttcattttcaaccgccgaaagcgatacacgctctaatttatgtttccaaagccgtctcgccccgtgcagaagatcaaagtgcccgaagtcaggaagtttcggaagcctgtcccgcagcaatgtatgcctggtttttacctgcggccagtcaaaggcttttccgttatacgtaacaagggacgtaatgtcaacctcacttaaaaagcttttgtaaagagctgtctcgtttcccggtttagggagcagatgctgtttaaccgcgacacggtcttcatacactcttgcatggccgagcaaaaagatcatattgcctgccccgccgccgaggccggtcgtttcagtatcaaagaagaacagctggcttttttcgtatccttctgctgataaagtatgtgtcaaaccgcctttattccataatgccatgacgtcatcaagttcactgaagctgtaccgtccgtggcggtgcgaaagcggatagacggtttcgcggataagacagtattcatcctcaaaaaagaaaggcttcactccgaatgcctcccattcttctctaaacgggacttgaatatccgggaccgaaagttgtgaagctgccggctttttttcagcttccggcacattcaggtggtttttcatccgctttaatttatttttcaaggacatctttcgtcccccttttcttttacacgtaattcaagagccggagtatcgctttctttgcatctattccttctatttcggagccgatgcaggaaggacacccgtcttgacatggacattgtcggatcaggcgctcagccccttcattgatttcatcaaatcgtttatatacttcatcggcaagtccgattccgcccggataatgatcatacagaaagattgtcggaagtcccgtatgtgcggctttgatttgcggcacgacatgcacgtcatttcgatcgcacatgacgtatacaggcacgatatgctgcaggacgtgggcaatgcctaaaagcagctgttcaagcgttttttcgccgatttccgaatccgtttcttttaattcaagccagactgcactggtatgcagttcttcttcaggaagatgaatcggtcctgatcctatattttcaaatgtcgtcattttaatttttttaaatattgtcggaagtgcgttcacggtgacgtcgccgaaatgtaaggccgttttctttctgctgtccgttctgtcaatgtccagcactttcagctgcaccgctaaattggcatctgtataatattcgacatcgacctttcgcacgtacgcttttttatgttcccaatcaagcttttcaacctgatactgcaccccttcatgaagataaatcgcttcatcatgaagaagcgtcatcgcgctgaagcggtccatttctccgatgatttttacatcagccgtctctgaccggtcaacgatgaccacgttttcctgtgacgccgaacggagactgatattggaggcgggaaaagattcgctcgcccagtgatagcgttcgcggttttcgtgaagcaccccttcttcctctaaatactcgagaatgtccctcgcatcattttctccgaatgtttcatcggctctgaaaggcagctcatatgcggcgcatttcaggtggtcgaccaatataatgagattatcgggattaatccttgcagattcaggcgagcgtttaaagaaataatcaggatggcgcacaatatattggtcaatcggatcagagttcgccaccatcacgataagcgcctctccctgccgccgtccggcccggcccgcctgctgccatgcgctcgcgacactgcccgggtaccccgtcatcacgcagacctgaagctggccgatatcaacgccgagctccagtgcgtttgtgctgacaacgccgagaatgctgccgtctcttaacccccgctctatttctcttctttctttcggtagatatccgccgcgatagcctctgacagacttcgcgccgatttctttttttacgatctcctgaatgtggcttaaaataatttcgacccggacacggcttctggcaaaaacaatcgtctggatcttattttttaaaaaagttttggcaagttcgttcacttccacggtggcgctttttcgaatatgcagcggtttatttacaatcggaggattgtaaaaagcaaagtgctttcttcctgccggggcaccgttgtcgtcaatcaggcgcacagattttcccgtcagctgctccgccaactccctcggattggcgattgtggcggatgtacagataaatgacggcttgcttccgtaaaaagcgcagattctcattaaacggcggatgacgttcgccacatggctgccgaatacaccgcggtacgtatgtaattcatcaatgacgatatatttcaggttttcaaacagactcacccattttgtatgatggggaagaatggctgaatgaagcatatcgggatttgtgatcacaatatgcccggcctttctgactttctgcctgatagccggagacgtatctccgtcataggtgaagcttttaatatccatgcccgtctcgtctatgatttcattcagctcgcttttttgatcctgcgcgagcgcctttgtcggaaataaataaagtgcgcggcttgtggcatcttccgcgatagactgaagaaccggaagattatagcacagtgtttttccggaggccgtcggtgtgacggccacaatgctttctccgttttgaaccgtctgaaaagcggagtattgatgtgtaaaaagccgctcgatccccctcttttcgagagccgcccgaatgttcggatctacttgctccggcatcggcatcgttttcgcctcccgcggttcctcttcatgccaatgcacaatattttcatgattttttaattcctgaatcagttcgctcagtgattttttcttcatcgttcacacctctttatgaggtacagtttaccgaatatttgtttgcctggctagatgaaaatcctgcacaagaaaaaaagcagggaatcagcccctgcctacttcatttttatcgtaaaaagctctgtttgtccttttttcgcttcatttgcgcctgcaaattgcaaaggttctgcggcatcgccattcataatcaccatagggatgacggtgctgcttgctttttcttttattaaatccagccggcacgttaaaagcagatcgcctgttttcactttgtctccttcttttacatgcgcttcaaagccttcgccgttcatattgacggtatccaaaccgacatgtatcaaaagttccgctccggaaagggtgcggatgccgacagcgtgttttgtatggaacagctgaatcacttctccctcaaccggtgaaacaatttctccgtttgcaggctcgacggcgatcccgtcccccatcattttttgtgaaaatacaggatccggcactgaagccaaatccatcaccgctccgtcagccggagaaaaaatcacttcctcggccggctttttccggctgtctcccaatccgaataattttttcagcaatgtgttgtgctccccttcctaaatgtgaatccgttaccagtttattctccactatttaaccatactttcttttttccttcaattcttaaccatacggcatagcatcgcatagtctgtttgtaaaaaggcggtggtcatatggatcaatcccaaaacgataaacttgatccgcaaagtaatgaggacatcatcagccatgcgatggaccaattttttcactcaggtcccttcgcagaattgatgcagggttttcagcaccttgtcaattcggcttttactgaagcgcaagtgacgattgacgtcagagaagagccgacggggctcgcggttgatatcggcgttcccgagacgttccgtgacggggatatgctggtggaaacgaaagggtgctaccttcacgttacaatccgctacgatcataaacaggctcaatcatcccatgtgtcttcaagcatgacaagaaccgttgtcctcccgtataaggtaagtgaagaagatatggaaacatcctggaatgaacagacgcttaccttctttttccctaaaaaataagcatgaatgatggatatcattcatgctttttatttgaagatactggtgaagcctttcaccagcgatccgacctgatttacggcgcttaccatctgccccgttgtatccatcattttattaaagtcaaactgtccgttcgtttttttaaactgggagagtatgcctgagaattgggaagactgctgctgattcggtctgggaacggggtaaggattcacaaaccccggctggcccccgggcatgcctgcctgaggaggagcaggagcaaacggctgctgtatatgaccgtattcctgattcggataaaattgctgcgggtactgcccttgctgatgatatggcggctgttgcaatggctgtatctgctgcggatacggcggctgtaatggctgtatctgctgcgggtagaaatatcccgccggctgctggtacatattttgatatggctgcgctctccattgcatatgacattccccccttgtctctcactaagtttctgctatatatgtatgaattccgccttggttatgtgctttcggtgattctgctctttgtcaaatgctgtcgaaagtcttaattttttaaaaacagaaaaaagtcgaatcgttatgttaacataatctcaacatacatgagaggggatgcaccattatgaacgtatcatacttaagaaagcgttttgctgaagtgaaaaaatatgaaacagattgtgcagataaactgatggactttgcaaaattcctctatattcaaggccatctcaccgcaaccgaatttcgaaacagtatgaaggttctcgaagcaagtggagcagaaaacccggcgtatgaataacatacccgacccctttatataaaagaaggcagccgttttcagctgccttctttttcaatttcatcccttaatatacgaagcgtatataaaacagattcagttaaatccctgtatctttttttatgaatatgatgaacatatgattggagcatcagctccccgaaattttctgtaacggcctgaatttgtgcatgatgaacgtatttcggacggttttcctgaataaacgcaagcgctgcttctgtccaaagcgcgcaaagccggtctcttttttcaacatcgggtttaatcgtctcaaaaaaatcatatgaacggcctgactcttttccatcctgataccttttttcggcttccagaaccgcctctatcatttgttctgtcagctccaataacgactgtgtctgcaaacggactcacctcagtacatatggtaccaaagtttttgcacaaaatcagcttatccggcagactcgcggcaaatcctttttacgccggtcagtcaaaaacaggtcatcaatacaaacatgaagctcccgcgcctcttcctcaagacgggaaagtttctcctgtctgatttcttcagcttccgcctgacagcatctgactgcttgggtaagcgttttttcagcagcagaaatccggatttcgatatcagaaagcagacggagaatatcagccttgctcgtgtaaacagacattcatgttcctcccttttatcacttgcatctctttcaaatataattctcgttttcataccgctctcctctgcacatgacaaaactagaagcagttcggcaaacaaacagagattatcctaaaaggcgtgcctttcgacaaaaaagtgccgcaaactttgtatgaaccggcacgttaatgcaaacgatacagttgaggaggtgccgtatgaaaacgagaccgaaaaatgcaggtaaacagcaaaaaaccgaagcaaaaacgactgatacgcttgataaaaaattaggcggcccaaaccgcccttccacgtaacacatcagcagcccgaaaccccagcgaacggtttcgggctttttcatttcttcagccactctttaaccgcgaagagcgcatggagctcccgtcttttctggaagtaccagtccgtcagttcaagctgtttcggcattttctcctgtaagaaagccccttttcttaaccttttttgaaaccaatccgccctttcgccgtctaatgggtgggcaacaatgggataggttgtcctaagcatcggtgatgttctttttttgatgccgatcattttctccatatcaaagcgtgaaccggtatgaggaacggtatcaagaaaacggtaaaaagaagcgtgaagatcagggctgaacagaaggcgggccagctgttttccgagcgtaattctctcttcggtttttgaaaaccgtttgacggaaattccgtataaatgtccgtcaaatgaagggaatatcaccgtattaaagtgaaaccaatcacttaaataaaaaggaatcgtgccaaaaacattctttttaaacgaaggattttgtataataggtgcttggatagtgttttgttcatttataataagagcatacatgagccgttccgtatctccgtcacgccaaaagcggaaccattcttcctgcataaaagccgagacgcggaaataaggaagatgacggaaaagaggttcgccgatttgttttgaccactggtagaccagaagctgaggataggcatcagaaaaaatcagccaattcgccctttcatacgaaaggaaaaaccagtttttctgactgctgtcaaggccctcctgataaaggacgcctcttaaatcagtcatcgaccagcccgcattgcgggacacaaaggatgccaaaagcggccacttgatctcaggatggcggtcataatatgctttataggcattcgtccgggaaatattatcggcattttttattttcgtctctttttcgatcaggcgaagaatggcggttacggtctgtcgtttatgcacgttcattcacttccgtcactattagtttgataaggaggatggaaaaagtgattcggtacccgaatggaaaaacttttcagccgaacaaaacggtttcatcccaaaacagccagaaacggtctcattcatacagtaatcgcggcatgaccctcgaagacgacctgaatgaaacgaataagtattatctggctaaccaaattgctgtcattcacaaaaagccgacacccgtccagattgtaaacgtccactatccgaaaagaagcgccgcagtcattaaggaagcttattttaaacagtcttcaacaactgactacaacggcatttataaaggacgctacatcgatttcgaggcaaaagaaacaaaaaacaaaacggcatttcccctgcagaattttcatgatcatcagattgagcatatgaagcaggtggtcaggcaagacggcatttgttttgttattatatccgctttcggaaaggtttatttcctcgaagccgacaagctgtttgtcttttgggagagaaaggagaagaacggcagaaaatcaattcgcaaagacgaattagaagatgcttcctttccgatttcccttggatactcaccgagaattgattatattagtattattgaacagctttatttttcgcaggaacagtagactgagcgaaaggttgataaacgaaaggttgagatgttatgtcagatcaatttacgagccgtgaagaacgccgtaaggcaaggcagacgaaaagcactaagccctcttcaccgaaaaaaggcaagaaacagcgtaaaggcggtttattcaaaaagattgtgctgtccttggttattctgtttgtccttggcatagtcggcggagcggcggcatttgccgttttggtttccggcgcgccgtctttggacgaagccaagctgaaaacgccttactcttcaacgatttacgataaaaacggaaaagaaatcgcggaagtgggcggtgaaaaacgaacctacgtcccgattaaggatatacccgatgttgtgaaagaagcatttatcgcaactgaagacgcccgtttttataagcaccacggtatagacccgattcgtatcggaggcgctttggtcgccaactttacggatgggttcggttcagagggaggaagcacaatcacccagcaggttgtgaaaaactcgcttttgacccatcagaaaacgattaaacggaaagcacaggaagtgtggctttccctgcagctggagcgccattattctaaagatgaaatcttagaaatgtatttaaacagaatttatttctcaccgcgcgcctacggcgtcggaaaagcggctgaagaattcttcggcgtaaaagacttgagcaagcttacggttgaacaggcggcaacgcttgccggaatgccgcaaagcccgaccggatataacccggttaaaaacccgaaggcttccgaaaaacgacgaaacatcgttctcagcttaatggaaaaacaaggattcatttcaaactctgaataccaaaaagcgaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggactgaaaatttacacgactcttgatacgaaagcacaagattatcttgatcaattgatgaacggcgatacagccggatttaccgaaggcatgcagggcggcgtcacgctccttgatacgacaaacggagaaatccgcgccatcggggcaggacggaacagaactaccgggggattcaattatgcaacacaaggtaaaacccagcccggttcgacgataaaaccgattcttgattacggaccggtcattgaaaataaaaaatggtcgacgtatgaacagattgacgactcagcttatacgtactctgacggcacaccgattcatgattgggacaataaatacagaggccagatatcaatgcgagaggccctcgcagactcacgtaatattcctgctttaaaagcataccaagcagcaggaaaagatcatgccgtcgacttcgcaaacgacttaggattgggattaaacaaagatcaagtatatgaaccctactctatcgggggatttggtgagggtaaccgcggtgtatctactatgaccatggcaggcgcctacagtgcgttcggaaataacggaacgtacaacgaaccgcacgcggtcacatcgattgaatttaatgacggcactaagcttgatttaacaccgaaaccgaaaagtgctatgagcgactacacagcgtttatgattacagatatgctcaaatcagctgtcgaatcaggaacaggtaaactggctcaggtggcgaacgtggaagtcgccggtaaaacgggtacgaccaactttactaaagaggacattcaaaaatataacattgctccaggcggagtcccagactcatggtttgtcggatacacccctcaatatacagcggcggtttggaccggagttgagtctggcaacaaagcaggcaagaaatcactgtcttctgcagaccagcaagtcgcaaaacggattttccaaaagctgatctcatacgttgatgacggtaaaggaagcttcaagcagcctgacagcgttgtaaaagaaacagttgagaaaggctcgaatcctgccgctttagccggaccgaatacgccggatgataaaaaagtgacggagtacttcgtgaaaggaacgcagccaactgccgtttctaaaacgtacacgaaagaaaaagccgataaaccgacaggattgcaagtgaaatacgacaaagataaaaaatcattaaccttaagctgggattatgacggtgatgcaacattcaatgtcaaacaatccgttgacggcggaagctacagtgacattcaaaacagttcggcaaaagaagccgtcgtctcaaatgtcacgccaggctccacatacagcttccaggtgacagcggaaaacgatgacggaaaaagcgatacggcatcagcatctttcaaagtcccgaaagatgaagaagacgatgcggataaagataaagcgactgacgatgaacagaagactgatgaagataaagataaggacaagacgcaaaccgatgattcaaacaaagatgacgatcagacagatacgtctgacggatcggatcaaacaccaactgatgacccggataaaaatcaggatcaatccgataaggatcaaacagataacaacaatcagaatcagcccggcaacgggaccgataacaacggacagcaagataacggctctgataatgattccgattccggttcagacggctcaaataaacctgacagcggtcaaacggataaaaaccaagactcatcttcaactatcaacgggcagtccaattcgtcaaccatccagtcaaatcccgctcattagcggacgaaatccttcaccccaaacaggtgaaggatttttttcgtacaaaaaacctccttatgggaaaaggaggtttttaacatttgttcatggcttcatatttatgatattgtttcttcatctccgtcatcaattcatccagctgaataaacgagtgatattgagtcggttttgttaaaataaacgccattcgctccgcccaattgatcggttccgcgggaaaatgctttgtttcaagcacagtccagtcgagtgatgtgacccgctcccctgccgtccaatgaaaagcggcaatcagacaggctattcccttcagcatgtcattttgatcacacctcgattttcttgtttgaaaaacgggaagcagcgtttctttcgtttcattccaaatctgaaaaagaaacgggacatattcgcccctttccctccatggctgcactgttggctggccgctgaaatccatatacagcggatggcggcgcagcgccgctttgatctcgaggctttccaagtccgtaaggctgcgcaggtatgtttcatagcctgccagaatgtcaatcgccgtcaccgtttcaccagcccttttttgtcacgcttctgcccttctctgcatagcggaagcaaaggacattccgcacagcggggagattgcgctttacagtgataccggccgaaaaatattaatctgtgatgcgtaacagaccaatcctctttcggcacttttttcattaatgttttctctacttccaaaacagagtccttccagcggcagatgccgagccgtttagagacccgctccacatgagtgtctactgcgatcgcaggtacgccgaaagcaacagacacgaccacatttgccgttttccgtccgacacccggcagcttcacaagctcatcccggtctttcggcacttctccgccgtactcttcaatgatcattttgctcagcttttgaatatttttggctttattacggtacagaccgattgatttaatatcctgctggagttcttccagcgatacggcaagataatcttcaggccgtttatatttttgaaatagcgtttttgtcactctgttgacgagagcgtccgtacattgcgcggataatgcgactgccacaaccaattcgaaaggatttgaatggacaagttcacattctgcgtgcggaaacatatcgccgattttttcaagacaatattcaatctgctttaaatttaacacgtttctccccttctcatgttattgttccagccaattgtaaaaaggtacctgcctcgtatactctttttgcggatcattctgtttcgtttgaacacgccggaatttttggctgtgcgccttcgcctgctcaaccgttttgaagccattctttttccattcaaataaaatccggtcaatatagcgaaaactgagtttccccgataaaacggcttcttttaaggcgtgtttaatcagaatcgcatcatgctgatcctgatcctgccatatggccagcgtctcgcattcaagcggcgacagcggtcttccgaactcttcttcaaagatggtatacaggcttttttgttctctttctgacgttctttcctgcgtttcattttgagaatgctgcatgtaatcatacagcttcgcccataacggctgcagagaatatttttcaaactttatgccgttatggtcttcacattcttcaataaacagaaaacctttttgaataaacattctcaggcagcttgtacactcttcagcagagatggacatgcctgattgaagttcaaacggcgtcggaaaataagagcccttttccaaatgcattttaatcttcaaaagcaggatcaattcggtttcattcagcccgagctgccggtaatgtgtcagcagcaggttgggaatgcttgaaatgccgagttcctgcatatctataaattgctgttttttcatccttacacctcttactgtaaaaggttatctccgggagctttcccctttacttagaaaaagtctcccttgcaggagacttcgtttttcataactattacggatacagacggttcagaagtctcgggaacggaatcgtttcacgcacgtgaggcgctccgctgatccaagccactgtccgctcaagtccgagaccgaagccggagtgcggaacagaaccgtattgtctgagttcagcataccatttgtaagcatctgaatccagaccgtgttcttttaatctttcttccaataaatccatatcatgaacgcgttctgaaccgccgatgatttccccgtagccttccggagcgattaagtcggcacataacacgacatcgtcacgatctttggcaggctgcatatagaacggttttaatgacgtcgggtaatgagtgataaacaccggtttgtcatagctttctgcgatcgctgtttcatgcggcgcaccgaagtcatctccccactcaatatcgtcaaagcctttttctttcaggaattcaatcgctttatcgtacgtaatgcgcgggaatggcgctttgatttgttcaagcttcgatgtgtctcttcctaatgtgttcagctcgatcttacaatgttccagcacactttgtacgatgtatgcaacataattctcctgaacttcaaggttttcttcaaattcaacaaatgccatttcaggctcaatcatccagaattcgatgagatggcgtttcgttttcgatttttccgctctgaacgtcggtccgaaagagaatacttttccgagcgccattgcagctgcttccatatacagctggccgctttgagacaagaaggcgtcttcatcaaaatatttcgtcgcgaacagctcagtcgtgccttcgggagcgcttcccgtcaaaatcggcggatcaactttcacgaagccttctttgttgaaaaattcataagtcgcacggatgatttcgttacggattttcataatcgcgtgctggcgtttcgaacggagccataaatgtctgtgatccattaagaattccgtaccgtgctctttaggcgtaatcggataatcagtcgcttcgtgaatgacttcaatggatgtaacagcaagctcatagccaagcggtgaacgctcgtcctctttcacaattccttttacataaagtgacgtttcctgcgtcactgatttcgcaatttggaagatgtcttcttctacttcagctttgacgacaactccctgaatgaagccggtaccgtctctcagctgtaaaaatgcgattttaccgcttgagcgtttattagcgacccaagctccaatcgttacttcctcgcctgtgtgtttatacacttggttgattgttgttttcaaactctttccctccagaacaagaaagacattcaggaatctgcctgaatctcttttttcatcactttattatacccgttctactctaacggggtcaatgcaagtgaaaagcggctttaaaagccgctttttcagaatcagctgtgtttttccgtaaagcggcggattctcttgaccgcttcttctaaaagatcgagtgacgttgcgtaagataagcggacgttgtccggtgaaccgaaacccgagcccggcacgatggcgactttttcttcttccagaagcgccttgacgtattcatcgacatctttgaatccgcagttttctgcggccgctttggcgttagggaacaagtaaaacgccccttcaggtttgacacaggtgaatccgggaatctcactgagctgagcgtaaatggtattcagtctgtcctcaaatgcctgtctcatctcttcaagcggctcagccggcccgttataggccgcaatggcgccgtattgagcgatggacgtcggattggatgtgctgtggctcgcaaggctcgtcatcgctttaataatcgtctccgaacccgccgcatagccgatcctccagcccgtcatgctgtgagatttcgaaacgccgttaatgataatcgtctgctctttcaattcatctgaaagctgtgcgattgagacgtgtttttttcctccgtatgtaagcttctcataaatctcgtcagaaacgatcagaatgccatgctccagacacacttttccgagttccgcaagctcttccttcgtatacataacacctgtcgggttgctcggtgaattgataatgagggcttttgttttctcggtgatagcctgcttcagctgctccggtgaaattttaaactgattggattccagcccttctgcatagacgggacgcccccctgccagtttcacctgctcaggatagctgacccagtaaggagtcggtataatcacttcgtccccttcatcgagaatgacctgaaataatgtatacagagcgtgtttcgctccagtgcagacaatgatttctgacggcttatattcaatcccctgatcgtttttgaatttttttgcgatactgtctttcaaggccggcagaccgcctgaaggcgtatatttcgtatagccttcattcatggaacgcaccgcggcatctataatgtgctgaggcgtattaaaatccggttctcctgctccgaggccgatgacatcatggccttccgctttcagctctttcgcttttgcggtaattgcaagtgttgcagacggtgttaatgcggatactctttttgccaatttcaacttgaactccccctaatacgtctcacggtgtgatgtttttgagaatcttgccgcttgtaaagtccacatagctaaagctatactgcccgcttttgttgatataggtcacttcccataacggaacattgttttctctcgccgggtgaacgccattcagcttggaaacaagcccttcgtcccgaacgatcttggcagccttgccgcttgaaatgccgtcactggctttttttgagagaatttttgcttttttgtcggccggaacccatacatacatatcttttccatgtttatccgttccggtaacaacataatatttctgtttgccgacaaaggtctccactttctcagcgtctgtcagattcgttttttctttagcggctgcggcagctgtttcgtggccttcttctttttgagccattgcagatttaaaaatgctggccgaaaataaaagaactgctaaaaaaataataccaaatacggctgtaaatattaatgctttttttctcatctttttcacctatgtgcgataaatggtgaagaccgcttcattttgattttcttcgtcgagcgcaaggccgaacatcaggttgtcccgtttcaaagtccggtttaatgtatcgacgattttatataaatcatctgaatgctccacattaatcgttgacagaatttcaattttgctttccatttttataccctccatcggtcgaacaaattttgttagtcataacgggatgcgcccgcggcataataaaatcacaaggcggcatgaacccgcttttactataaaaacaattcctcatcccacaccacgaaagccgcgtttatgcggcttttattccgtttggctgacataagccccgagttcggcatccgtcagctccaaaagggatgaagtcgggagcgcttcaagaaacagccgtccgtatcccgccgtctttacacgctgatctaaaagaacgatcgttcccttgtctcccgccgtacggagcaggcgcccgatcccctgtctgaacgttaacacggcctcaggcagggaaatcgtctgaaacggatttttcccctgcttcttggcaaattcgcattttgcggcgtgaagcggattatcaggcgccctgaaaggaagtcttgcgatcatgacggttgacaattcatcccccggaaaatcaacgccttcccagaaatgattcgttccgagcaaaatcgaccggcttgccgttttaaaggttttcattaatttaccgggactcccgcctgaaataccttgggcgagaagctgaatgcctgagatctccatactgagtttcagttcctgatacacttttttcagcatatcatgagacgtaaacaggacaaggatcttcggctgttttccctttgacatgatttctgcatacttggcaatatgctcaatgacttcccgctccccgtcatatttaacggatttcatctctttcggaatgatgacgttcatctgatcatcgtaagaaaaaggagacgggatgcttttggtgcgcggataaaaatccgcaagtccgagcctttcaatcataaattgaaaagactgctccaccattaaggtcgctgatgtgagcacaacgctttttttgcgggcgaaaaactggtctgccagcatttcaccgggctccaaaggctgcgcatagatgctgacggcattttttgcgcccttcgcatcaatttcaacccaaacggcttctttctcatcattttcaaacagcagcctgctgaacgtatcgcgatattctttcagccccctgatacactttacatattcgcccgctaaaaaagccgctccgcttttcatctgatcaagcttttgatgtaacagtttctcctgtacggaaaacatgtcaagcagctgatcaagcatcgcacaaagccgctccgctccgtccgttatcatgtgaaaccctttatcctggcttttatgattgagactatagacgagacggttcagatcgtctttaggttttcttcgtttgacaaaagaatgcactgaactgaaaaatgcgtcgctttccgattgaatatgcttcatccactcatcggcgtcaaaaaaactttccgccggcagttcatacgtataaaacagttttctcatccgctttaacagtccgtgttcctttaaggtcccgattcggctgagctttgtgtgcagtccgatgtatgaagctctcttccccaggtgctcgctggcggcgcgttcgaaatgatgcgcttcatcaatgatgaccgttccgcttgcaggcagttttttcgtttcactgctttgatctgaaaacagcaaagcatggtttgtgataatcagatctgcggcctgcgctttttctttagcccgttcataaaacccggcagccgagtccttcccttttttcataaaagaattctcatcgtaagccatgcgctcccacagcaatctgccgcctgatggaagattcagctcagcggcgtcgcccgtttcagtctccgtcagccagacgagaagctgcgctttcgtcaaaaccgcatcatagttgtcatcttcctcatgcagaatatgttcaaacttcggcaggcacagataatgtgatttcccttttaaaatagcagctttgaccggccaaggaaacatacgctccaaaagcggaagatctttagacatgatctgctgctgcaaaagagtagagtacgtgctgataatgacgggagtttgttccgctttggcaaataaaacagccggaacgagataaccgatcgtttttccgatgccgggcgccgcttcaatcagcgcatgctcccgattgcggaaggcgccaagcacttcatccatcatcgtaagctgtcctttccgcttttcatagcgggggatgatgccggacaagatctgttctttttcttcgttccacttttcaaggtcaatggccgcattcaccggacgggaaaccggaatgtgatcgggctctttaattgaaaaagaggcgtatggaatgcagctcttttcttccgccggcctgctttcatgaataaaagaatccaaaagcagcgtcaaatcgctgataaaatgctgtgaaagccttctaagctgctttaacgtcggtaaaggcagatgtttcagtttatgtaaaatgtctaaaaagaccaggcccgtaacctccgcatcgctgtctgcgcggtgagggcggtcatgaacaatattcagctctgcgcacaactcaccgagcttatatccttcaaaccccgggaaaacaatacgcgaaagctcaaccgtatcaagcacttcacaatccggcagctcatagcccgcttcgctcagttcatgccggacaaatccgaggtcgaaatgaatattgtgggcaacaaaatacgcgccgtcaagcagatgaaaaatctcctctgcgaccgcttcaaacggcagttcattttcaaccattccggacgaaattccggtcagctgttcaataaacggcgggatggcctgattcggattgatatattttgaaaaccgctcagttatttgtccattttcaatgacaaccgctgcgatttgaatgattttatcgccctttttcggcgaatttcctgttgtttcgacatctatgacaacgaaccgttgtttgttcattaaaatggacacctcaattcttgcatacgagaaaagtgtaacacgttttgttgagaaatggagcggaaaaacagcttttgcccctaaatcttaaaagaaaacccccatgaagggggctcttttacaaaatcgtgtgtgccggctcctggcccagcatctgctcgattttattctgatcatccagaacggccaccttcggctgatggctttttgcttcctgatcagacatcatttgataagaaataataatgactttatctccttcttggacgagacgggcggcagctccgtttaaacagatgacgccgctcccccgcttaccgggaataatatacgtttcaagtctcgctccgttgttattattcacaatctgaactttttcattagcgagcattccgacggcatctaaaagatcttcatcaatcgtgatgctgccgacatagtttaaattggcttccgtcacggtagcgcggtgcagttttccggccatcatagtgcggtacatattatgatctctcccattcatcaatatcaataatgatattatcaatcagtctggctttagaaaattggacggcgcaggccagaatgaccttgccgtttaatgttttaagcggagtcagctccggataagcgtacagttcggcataatcaatgacgccgcttgtgttttcgatgataccggtgacggtttttataacggtttccggatttctttcaccgtctctgaccagttcggcaccttgctgcaatgctttatagatcatcggcgcttctttgcgttcctgctcagtcagatagacgttgcgagagcttttggcaagtccgtcttcttctctgaccgtgtccactgcaaccaattcgatatccataaagaaatcctcaatcaatccgtccacaaccgctgcctgctgggcatctttcaggccgaagtaggcgcgggtcggtttaacgagattgaaaaacttcgtcagcacagtggccactccgtcaaaatggccgacgcgggagacgccgcacaacacgtcagttctccttttcacttgcacggcaacattttgctcgcccttatacatgtcactcggagacggcgtaaacaaaacatctgctcccgcctgttctgcaagccgggcatcgcgctttaaatctcgcggatatgcttcgtaatcctcgcccggtccgaattgagtcggattgacaaagatgctcatcacgacaatatcgttttctttgtttgctttttcaaccagggtcaggtgtccttcatgaagaaaacccattgtcgggacgaatccgatcgtccggccttctgagcggtattgtgcaattaattctttcagctgttgagtttctgtcagttgtttcatcgcttactttcctccgtataagccttgcagcacagtttggtttatctgaaaggaatgcttttcttccgggaaaacccgttctttcacatcacggacataatcgctgagggccgactcaatcgtgccgtcgattttggcgtattgcttcacgaacttcggtgttctgtccacgccgtggccgacgacgtcatgatagacaaggacttggccgtccgcttttgaaccggctccgattccgatgacgggaatggatacttcttctattattttagcagtcagttcagcaggcacacattcaagcacgagcatcatcgctcccgcctgctcgcatttgatactgtcttcaatgagctttttcgcgctttgctcatcttttccctgcactttatatccgcctaatacgccgacagactgcggtgtgaggcctaaatggctgacgacgggaattccgccgagagtcagcgcgcggatggattcgaaaacgccgtctccgccttccagctttaacgcgtccgcgccgctttcctgaataatggccgcggcgtttttcaatgtatcctcttttgaaaggtggtaagacataaacggcatgtcagttacgataaacgtatttttcgcaccgcgttttaccgcttttgtatggtgaatcatgtccctgaccgttacgccgacggttgaatcgagtccgagcacgaccattccgagcgaatccccgactaaaatcatgtcgactcccgcctgttccgcaagctttgcctgcggataatcgtaagcggtcagcatcacgatcggctctccgttttccttcattttcatgaaatccagttttgttttcattctgtttctcctcctctaaacggtgaggagatgagccgccaattcttcgcaagcaaaaaagccttctgtaaaataagaaggattcccacttgtttaacgttcggcgaatgtcatccctctgtcccagtccttttttggatcaaggcagacttttcgtaatctctgttctgctgatcaggtgcagttcattatgatactgcccataggaagtataccaaattcacgaggcttgtaccaactaagattaattgagctcaatatcggcagaatagatcttctttataccgtctctcgtttccaaaagaagaactccctcatcatcaatgccgagcgatttcccgtaaaacgttccttgcagcgttctcgctctgagctcgttccccagtccgaccgcatagctttcccatagcagcttgatcggtgtaaagccgtggttcaagtaatcctgatagcgtttttcaaaagtcagcagaatctcttgtatcagacccgctctgtcaattttttcaccggcttccatgctcaggctcgtcgcaatgtcctgaagctcgccgggaaaatcggtttcctgctggttcacgttgatgccgatcccgagaataaccgaacggacacggtcctcttccgcctgcagctcagttaaaatcccgacggcttttttgccgtgaatcattaaatcattcggccatttaatggcggcctgtacgcctgtaaaagcctcgatggcctgtacgaccgcaacggcggataacagggtgagctgcggcgttttttgcaaaggaacgtcgggtctcagaatgaggctcatccaaatcccgtttccctcctgtgaatgccatactctggccattcttcctctgcctgccgtttgtttatcggcgactacgagggtcccttccggcgcgccgtcattggcaagttcatgagcggttttttgggtggacggcaggacgtcccggtaatgaagctgtttgcccaaaacctctgttttcagcccgaaacggatttcggattcactgagtttccccggttttttaatgagcctgtacccttttcgtctgaccgcctcaacctcatagccctctttgcggagctcctctatatgtttccaaacggcggttctcgagcagccgagcgcgtcacttattttctgcccggagataaagccgtcacccgcctcagaaaataaatcaattaatcgggttcttaatgttgatcccatgatgcgagccactcctttatgtcatgttttcggttaggaagcttccctgccaataccgcttcttcaatccggcgaagttcttcggccacccatttacccgcgcggcggtttctgagctccatcagatcagcgcctgaaatgtcgaggtctcgaaggcttttgatcggcagctgctcatacaggctctgaacctctttcagcttttgttcatcaatcgtcttatgctgtttcagcatcccgattttaacggctgaaaacagcgcctctcccgctcggtacatcgcttctgcttccagctgcgccggataaacgcttatgatctgcaccgctttttttatgacctttcccggcagtttccattgttttaaaaacgcctcggcacttttcggacaaagaccgagaaacaataacagcgctgcccagcgttcttcgcgtgcatctaaagaagaaaacggaaagccgcttgcttcaagcatttgctgctcataaccggaaaggccgggcagctcttgtatcagacctgtctgcaccatcgtttgaatcgcttcttgtgagaaagcgccctgcatcagcttttcaaactcgacggtctttcgttctactgatacatgtgccaaaagctccctgtcttttatgacggcctctcttgtttctttttctaacagaaagccgagctgactcataaagcggacggctctcatcatccgcagagcgtcttcccgaaaacggtcttcagggttacccaccgtacggatcagcttttgtccgatatcatgtgcgcctccgaaataatcaagcagctctccttcggcagacatcgccatcgcattaatcgttaagtctctccgctttaagtcttctgataaagaagtaatgaaccgcacagcttccgggcgccgatagtccttatattctgattcggcacgaaaagtggtgacttcataggtttcatcttcccacaggacgatgacggtgccgtgctcttttcctacatcgacagtccgcttaaagaggcgctccacctcattcggcgaagcgctggttgcgatgtccacatcacctatttttcgtttcatatagctgtctctgacggctcccccgacaaagtacgcctgatggcccgccttcatcagatgatgaaggatggggagggctttgacaaattcctgttccataagatcactccggtcctgccaattcgtcataaatccgttcatactgactgacgattctttgcgaagaaaaggaggtctccaccattttcagcgcatgatcagtcaatcgtttgctgagctgtttatcttctaaaacggcaagcgctttttcagatgccgcctgaatatcgccgacttccaccagaaaaccgcttacttgatctttaatcacttccgggatgccgccgatatttgttccgatgcacggcacgccgcaggccatcgcctcaaggaggacgagtccgaaactttctttttcagacagaagaagcttaagatcgctgatggaatacagctcttccaccctgtcctgatttccgaggagcagcacttgatcctgcagtccgtatttttcgacaagctgccaagcgacgcacttttccggcccgtcaccgacaagcaggagcttcgcctttgtgttggctgcgatattacggaaaacgcggatgacatctttaacacgttttacttttctgaagttcgaaacatggatgacgaccttttcatccggcaaaataccatgtttctcttttatactctctgtatttttcttaagataaacacgttcatcaataaagttgtagatggtctcaatttttttatccggcttgattaagtcatatgtttctccggcaagcgcggttgataccgccgtcactctgtcggacgcttcgatggcaaaacggattaaatcttttaatgacggatcatatcctaaaacggtgatgtctgtaccgtgaagcgtcgtcacgatcccgatgtcacgcttgagcatctgtttggctagataagcgcataccgcatgcggcagcgcataatgcgcgtgaatgatatcaagattttccctcgcggccacctcggcgattttgctcgccagtgtaaggtcataaggcggatgtttaaataccgcgtattgattgacttccacctcatgaaaatgaatattcggatgatatgtatttaatctgaacgggatgcttgatgtgatgaaatgaacctggtgccctttttccgcaagcagcttgccgagttccgtcgcaataatacccgagcctccgacactcgggtagcatgtaatccctatttttaatggtctcattgtccgcccccaaaaacatcatcattcaaaacgggaagctgttttgaaaagaagccttcagcataccccgtcccggcttctttgccatacagtctttcccgcgcttccaccatttcgatataaccgttggtcagcggtgtgttcactgactgcgccgtaggaataaactggctttgataagcgtgcaggctttcttttttcagatcgatggtttccgttatgtcgattacaaagtccggacggtgaaacccgttgatcatataatagtatacgcgctgagccttatgagccggcagttcctgatgatctctgtatttatgaattcccgccgagaacaccgcttcttcgaccaaagccgccgcattgccgtggtcaggatggcggtctttcggataaggcatgaaaacggttttcggccggcaggctctgatgacactgacaatccggcggatgccgtcctcacttttcaaaagcccgcggtcgggaagcgtaagctggattctctcttttacgccgagaattcgtgccgcctctgccgcttcttcttttcttatccctaccgttccgttagatgatagttcggcctcggtcaaatcgcatatcaccgcggtttttccttgagccgtaaattttgcgatcgtgccgcccataccgatctcgacatcatcactatgggcgccgaacgccagaatatcaacgtgttcagacattcggctctcctccgcgcacaagattgcggaaatcaaatgccccgccgtccagcgtccggacaaggatttccgctgttcccatatttgtggcgagcgggatcgcgtatacgtcacacagccggatcagcgcggagacatccggttcgtgaggctgcgcagttaacggatcgcgcagaaaaatgacgagatccagggcgtttgccgcaatcaatgcgccgatttgctgatctccgccgagcgggccggattgaaaacattcaacggacaatccggtcgcttcctggatttttaagcctgtcgtacccgtcgcgtataactcatgatggctcaatatatctttatatgcggtcgtaaactggaccatatcctgcttttttttatcgtgagcaatcaaagcaattttcatttgatgttctcccccttgccgattcagtcgataatattttcgagtccgtatacaagctggtcgattttcatcacttgctccactgacagcttcactcctgacataaaggaagcccggttataggaatcatggcgcagtttcagcgtctggccgtccatgccgaacatgacttcctggtgggcgataaggcccggcagacgcacgctgtgaaggcggatgccgtttaattcagcaccgcgggcgcccggcagaatttctttttcatcaggatggccctgctgcttttctgtacggacgcttgaaatcatttccgctgttttcagcgccgttccgctcggggcatccagcttttgatcatgatgaagctcaatgatttctacatcttcaaaatagttggcggccatttgtgagaacttcatcatcagcaccgcgcccaatgcaaaattcggagcgatgatggcgccgattcctttttcttcagtcaaggcttgaagctcctctaaatccgcttcagaaaatccggtcgttcccacaacggggcggacgccgtgttcaagagcggctttcgtatgttttttgccgatttcaggcgttgtcaaatcgatcagcacatccggttttgtttcttggaaacatgcgcggatatccgtataaataagagcgtctgaatcagctgacatcacttcccgtaatgtttgctgatcgtatgtatggtcaatggcgccgacaagctcaaaatgaggcgtgcggacggcaagttttacggcctcctggcccattctgcctctcggtccggcaatgacgactttaatggtttcatttgacatggtttctcctactttccttcttcttttctagtccagcggtctttatcacgtgtattaaatttatgcatgacgcggttatgagcttcctccaatgaaatatcaagggagttggcgaggcagatcagaacgaacagcacatcgcccatttcctcttccatgcttttctcattttccgtcgttttcttcggcttttccccataataatggttgacttcccttgcaagttcgcccagttcttccgtgagacgggccatcatggcaagcgggctgaaatagccttctttgaattggccgatatattcatcgacctcagcttgtaagtctttcatcgttttgtcactcactgtgcgaatacctcctgtcatctcttccatgttagctaattcaagtacatttgacaaatgttaaaaacggcagtttgctgttttcttttgtatccactataatatttacgcaatcttatggaaggaaaaggggtttgatgcaatgcttggagaaatcagaatcaaaaacatttgctttattttaatcggcgccgctgttttttcattcggactggttcactttaatatgcagaacaatttggcggaaggcggatttaccggcattacgctgcttttatatgcgttattccacatcagcccttctatttccaacctggtattaaacattcctatctttttcatcggctggcgtatgctcggccggacgatgtttgtctataccctgatcggcaccgtctctctttccgtttttctgagtgtttttcagcgctacgaaattcatatgccgctgtcgcatgatttagcgctggccgccttgttcgccggtgtttttatcggcgcgggtctcggcattatttttaaatacggcggcacgacgggcggggtcgatatcatcgctcggctgatcaacaaatttttcggaatcccgatgggccggacgatgtttgcctttgacgcctgtgtcattctgctttctttgtttacgtatctttcttacaaggaagcgatgtacacgcttgtagccgtttttgtcgctgcgagattgattgattttatacaggaaggcggctatgccgcaaaaggggcaacgattatttcttcgaaaaacgatttgatccagcaaaaaatcattgaagagatggagcgcggcgtcaccgttttaaaaggacagggatcatatacaaaagaagacagggacgttctttactgcgtcgttccgaaaaacgaaattgtgcttttgaaaagcgtcatcacttccgttgacccgcacgcctttgttgcagtaagcgacgtccatgatgtgctcggcgaaggatttacgcttgatgaaaataaaaatccgatcagacgataataaaaaggcggcttttgccgcctttactgttcgtgtttccatttgacaaccggtgattttttctttttcaatcggcgggcgaatgccggactgacattgagcgtctgctcgacgaagcgctgcggcgtcagtgccagccattggtttaaggagacgtcttcgaaacggtcgcttttgaagatttccagaaagcgaagcacggtgtcaccggtattctgaacataatgtcccattgcaacaggaacatatcctacgtcacccgcttgatagttaaatgtccgcgctcttccctccgccgcaaacaccgtcattttcgcttctcctgaaaggtaatactgccactcgtccgtattcgggtgccaatgcaattctctcatgcctccgggttcgacctccacaagagctgcagcaatcgtttttgacaccttaaacgtttttgaatcgacaatctttactcttcccccgctggtaacaagaggctcctgccgggaaagcttgtagctgaacggctctaaaacggggccttccggggaagagactgctgcccgctcaattgggggcggcggttccaactggaacatataacgctctttcttgtgaatgtaagccagctcatagcccggaacaccgaagttcgcctccagcacgctgcgcggggtgtgggcaaaccagtccgttactgaaaaggtgctgttttctgaaaaagagccgtcatcaaagacgagcaaaaactcacttccctgctctaatccttgaatggaatgaggaatgccggaaggaaaataccacaggtccccttcacttacgttatcaataaaattccgcccattttgatcgaccgcagttaaacgtactcctccgttaatcacatatccccattcggcttctttatgccaatgaagctcccgcacagctcccggtttcagcctcatgttcaccgccgcgatgtttttggataccggcagttccctgaccgtcacctctctggaccatccgccgtcttcaagcctcatatgcgtatcagaaaatgagaatttcaagttttgaaccgttcctgcatccgttgaaggcggaacgagcatgtcaggattctggaagtcacgcgcgaggtttcgcggtccttcgtcagtcgccccttttctgcctctgatcggctgcgggaggtgttttgaagccaattgctggatgagttttttcactgacttagctcctttacagcaatttgtgtttatttagacttaggatactcacgctttttctctttctttttttccgctctgtattttcggtagccgacatatgtcagcgcagtaataatgataccgcctgttgtcagaatgacccagagcagcgaagggtcagcgtcatcccgctccaccttgtcaaaaacccgctttaaatcctgctgcaggagtgtcagacgctcaagctttgttccttttgtcatctgctgaaacccttcctgctcaatcacctcgatatgtttcgccaccgtatcaagctggccggccgacacatccattgtcaggctgggataaattaaatcatataatgatataaattcattccacttttcattgaaatttccacttccgtttccgctgacatcttcttttaaggcgctgaatgtcgccataatcggtctttcaagcgaaccccacagcggatcggagtggtcttccatcgcatccattaccaacctgaactgggcggctgcccggattttttcggtatctgaggcgtctgcctgtttcaggacgcgcactaaatcattgaagcccagagtcacctgcctgacttcggcgccgctcagtgagtttacgtgtgtcatttttttcttaaagtagccaagcacttgcagagcctcatcatactgcgaatgccgcgtcatttggaaaacggtatccgaaaggtcgttcagttccttgagaccgccctcatcttcagctttggcagttgtgatgaaacacataagagcaagtaaaagacagatcgtcagctttcgtttcatagaggtccctcccactccttctctttacagaatatgaggagcgggacaaggttagaccaagattctatcagtgtaagtcaagctttatccgtcttttagaaatcaccaaatagtatgcaaggccgagtgaaaatatgctcagccagaatgtagcatagccgatctcttgcatatagtcattgagcattgagtagcggggcatcatgccgaaaagataatcaatgacgtcattatgaagcgtccaaacagcagcaacggcaagatgccataaccggaaccgaaaatacgggctgtataaaacgccttgaacggccatggcaaaatgtgaagcaatcagcatatacccttcccaaggcatctgccccattttgaccagcacaaagacattcattccgaccgcccacagcccgtattttacaagggttacaagagccagcgcttcaaacagcggcgcgtttcttcccatgagaaatgccagaagcacaaacaggaagaaaaacgtcgccgtcgggctgtcaggcacaaatatcagaaatcggaacggcgtgtccgcaagctgcggcacataccaataatagccgtacaccgtaccgataaaattaacggcaagaacaagcagaagcatgccgcgcaaccctaaaagataagaaatccacctcataccatcaactctcagtccgtaaaaagtatgtatcatgcaaaaaaagctgacatccggtcagctcttttcataaagtatatcctgctgttgtctacttcacaatacgttatttcgctgtcgtttcagaaatgaacttcgccagctgatcaagctgtttgtcattccctttaaaaataccggctggcatctgccctttccctttgacggcgatttttttaatttcttccgggctcagcccgttatcgaccagggacggaccggcgcctcccccttgaagattatccccgtgacaggaaatacagccttgttctttaaataccttataaccgtctgattcagtatcaatggcggcttcttttttaattttcccttgctcctccgcctttgcccagtcatgtgtcgcgactgactgccacgttaaaaagaccgtagcgcaaagcgccaaaagcatcatcccgacagcaaccggacgcttccacggccttctttcagaccccctgtcgagaaacggagccaaaagcagcgacccgaaggcaagccccggtataatcatcgctccgataacggtgtagctccctgcggcatattcatattttaaaagctggtataaaaatagaaaataccaatccggcagcggaatataccctgtatccgtaggatccgccacccgttccaaaggcggctcgtgcacaatcgttaaaacgagaaacccgacgaggaaaacggccccgaccatccattctttcagcagaaagttcggccaaaacgcctctgtctttccaggatactctgaatagtctttcggtatattcggttttttttcagccggtatccttgaatctcctacaaacttcattcctttcccccggtgcatgtcatcccctcccttttatatcagatttgtattaaagcggtcctgaaattccctgcttgcggatcataacaaagtgggcgcccatgagcgcaaacaaagcggcagggagaaaaaatacgtgaatcgcaaaaaatctcgtcagcgtttgagcgccgacaatatcgtggtggccggcaagaagagttttcacctgcgctccgatcaatggcgtcgcctcggcaatctgaagacctacctttgtcgcaaacagcgccttcatatcccacggaagcaaataccctgtaaatccgagaccgagcatcacaaaaaagatcagaacaccgacgatccagttcaattcccgaggctttttataagctccctgaaagaaaacccgcagcgtatgtaaaaacatcatcacgatgactaaacttgcgccccaatggtgcataccccttacaatctgcccgaaagcgacttcattctgcaaataatacacagattcccacgcgttttttatatccggcacataatacatcgttaaaaacatcccggagagcacttggataacggttacaaaaaacgtcaaaccgccgaaacaatagacaaaagccgagaaatggtgagcgggatttacatgttccggcacttcatggtcggcgatatcccgccacatcggcgtaatatcgagacgttcatccacccagtcataaattttattcagcatgtcacccttcccccctaggctttgcttttccaagatacaaaaagccgtcctttactttttgctcataacggtcaagaggcgcgagcggcggcgtgcccggaacgttcgtgccgtctttttcatacagcccgtaatggcagggacaaaagaatttgttcggatttttaggatcattgttccagtttacggtgcagcccaaatgcttgcagatcggagaaagcgctataatttcatccccatgcttgtaaacccaggctgacctggattcttccgattcgtaccaggcgtcgacttgatgaattttaaagtcaaaccgcttcggctccttcgtcagctcatccacactgacaacctgcaccattttttgatctcccgtcggttttaataccggatccagcgcaaaacggaccataggcataagcgcactggcggccataaatccccccacgccggtgagcgcatagtttaaaaattgtcttcttgatatatcttgttttccgcccatctcttccccccctaaagattgaccaaaaattaactaaaatagaaaataattctgagatttgacaccctcataatatatgaatctttcagcaaggtcaacagaggcaaaacgggtgttttgcaggatgcctggagtttttaagaattgttccacttctgtaacaaaacgttcaaaatttctccgcacttgtcatccgcaatttttctctttaaagagtctttcatatgttcaaacggaacggcaggtatgtatatgacatcagaccctatttcagaatccttccatttttcgtctgccgtcaggaacaaggcgtgcctgaagttggtcatcacctcttctttgagtttttgaagcagggcgatttgtgattggtctatatcaacatatgtataagaggggaataaatatacccgtcccttcaattggcgctcaagctcttcagaaagcaattgggtgctttccccctgttcaacggcctcttttaagcctcctgaagacgttatggaaattaacggaatgacagcggtatcaatgtaatccgcagattgtaaataggcatcggcatcagcggccctccatctcatgtctcgttcctcctctttacgcaacaagccttgcatattctgcaaggctgtcatttatgtgagctgattcaattggcgggaaagcttttcaaatgtttctttgtcgtggcggtccagcgcctcgtcgatatctttaagcagcttttcccgctggaaagtggaaatggcatgttctaatattttttcagccatcccctgatcctgtttattttcaaacaggtctttcggcagatgcggatttgattcaagaacagcggcatattccggtgagctgtaggccgaacggaaattcagctggataaataaatcctgctgtttatttaaccggatgtcgtgaaaagatttttccgcgtccgtagtcatgacattttctttgtaaaacctaaacggcacctcatcaacgcaatgagtagacatgataatgcctctcgggcaaaattcggcttgttctacaaaatggactttttccattaatgaatcatgactcattaaataatttaaaatccagacgcactcccggcgtttaagctgataatgatttaaaaaccaacggataaaatcctttttttcattgacagaaacaggggtctgcatgtaattccctcctctatcgatcgtataatctgacatcacttatacattcagcaagcatggtccaaaatcctgcttatcttaaaaattcatcctctatccgtaagattgtttcttcaagctcttcgtttgttccatccattgaaagcacttgttttaaaagcggcagcgcttctttctggagaccctcttccaataagaagtgagcgtattcatataagaaatcccgatcatcctgataatggagatacgcagcttcgaagctttttttcgcttcagcgtattgctccaggcctgtataggcccccgccaaataccaattgtatttcggatcttcttctccgtagccgcggacttcctgaatcagatcaataatctcttcaaagctttcttctttatgatagacggctaaaagcgtatggagcgcttccacgtaacccggatcgagcgccagcgcttcctgaagaagctttttgccttcctcttcgctgccgagctttaacgccattttcgccgcatagagaaaaagctctttattgtattcatcgtaagtaataccttctttagcggtttttaatgcatcttcatacatgccttctgcctcgtagctttttgcaagcggcatataaagcgatgaataggaaggatcaagcccttttaaatcagacagctgcttgatggctgttttgaccattcccgcctgataggctgtgaacccgtacccgaaaatcgtattcggttctgtatgttctgccgccgctttttcataccatgaaatcgcttcctcaaattcacccgccgcgctcaatgactcagccagcctctgatgaacgtttacgccgccgatttcgtgccgttcttttgccgtctcttcatagtaaggaacggcttttgcatatgatccctgagtgaagtataattcccccagagcgaaatcaataacaggttcatcttgtaacatcgctttcgcctgtaacagcttttgctcacttacttcaaataagccctgcatctgatacagatcagccattaaaaggaggctttccgcgtaagacgggtcttccggagaaatcgtctccagcacctcaagagctttttcttcttcatcaatatctattaacaattcggcgtaaaaattcgtcagctcagactcacccggatagaggtcatgcagatcactgatcagcgctaacgctttttcggcgtttccccattcatagtagagctgggctgcaatggctttgtcttcgtcatgaagctctgtttcagcttttgaaagcgctttgagtcccttttcggtttcacctgcttcaactaattttatggcttcttgaatcaatgtattcaaatcagaccggtcctttcttttcctatacctcatcaaccaaatgaaaagggtttttattcgggttattcttatcataattcagacagggcctgcccgcaaataagatgcttcacccggcattatagtttatcagaaaatggttaagaggaaaacggcaaaaaaggggacggcatctttatacgcaaacagcgcaatttgttccggctgtttctgtaacgaaaacgcattccccctttcttttagttttctgtttaagacaagctatgtcaaagcccaagattttatgacacatgaagaaaaaagcccgaagaatcgtcttcaggcttttttggctaattgatctaaatgctcaaagaatgtcggatatgagacatggatcgcctctgtatcacggatgtcgatcggctcttctgtcaggcatgaagcgataccgagcatcatgccgatgcggtggtcgccgtggcttgacacatcggctccgcccgcaagcgtttttttgccgtgtattttcatgccgtcttcagtcggttcaatgtctgcgccgattttccggagctctgatacgacggtgtcgatccggttcgtttccttcaccttcagctccgcagcgtctttaatgacagttgtgccttcagcctgcgttgccaaaagggcgataatcgggatctcgtcaattaaacggggaatgatttctccgccgatttctgccgctttcagagctgaggtttcaataaccaggtctccgtaaggctccgcactgtccgcttctgaaggaatcacttcaagtgaagcccccatttgctttaagacatcaatcattcccgtgcgtgtcgggttcaggccgacgtttttcagcacaatccggcttccgggaacgacagcgcctgccgcgaggaaaaaggccgctgaagaaatatcgccgggcacgaaaatatcggctccccgaagcttctgaccgcccgttacggaagcgctcgtctccgtttccgcaagctcggcgccaaaagcgttcagcatccgttccgtatggtctcttgatttatgaggctcagtgacggtcgtcgtcccttcagcctgcaatccggcaagcagcacggcagatttgatctgcgcgcttgcaacaggggagacgtaatctatgcctttcaattgtccgcctcttacggataaaggcgtaaaccctccgtccgctcttccgtcaatcgcggctcccatctgttttaaaggctccgtcaccctcttcatcgggcgctttgcaatactttcgtcacccgctaccgtactgtgaaatgggcgtccggctaaaatgccgagcatcaggcggatggtcgtgccggaatttccgacatcaagaaggctgtcaggctcacaaagtgcgtcaatgccctttccgtatatcgttacatcacttccgttttgttcaatggagacacccatttttctgaagcaggcaatggtgctcagacaatcggctccgggcaaaaagttttttaccgttgtcgttccttccgcaagcgctccgaacataacagaacggtgggagatggatttatcccccggaatatgaatttcaccgtttaaagacgtcactttttctcttttcaatgttttccacctcagtcagcgtaaaatgtgtcatatttggcgcgggattgaatgcaggtttccgcgcgcttccggtcatcatcagtctggaaactgattctgagaattccgttaatatcttctcttgtttcgataatgcggatgttggtgatactgattttttcttctgccagtatcgccgtaatttccgaaatgaccccggatgatcgggaacatcgacataaaggtcataaaaggacgggatcgctcctttttgacggagcggcaggccgtcgcgataatctttcgcttttttaaaatatccgaacaggctgtccgcatcttcattttctacataagattcgatcgtgtcaatctcccgtttccattctttgaagcggtcaagcagtttatctttgttatgaagaagtatgtctctccacatcgccggactgcttgaggcgattctggtgatgtcccgaaaaccgccggctgcgaaacgcttcaaaaacggataattttcttcagaatgatgagcctgatggacgaggcttgcagcaacgatatgagggaaatggctgatgacgctcgttacgccgtcatgctcctcgggagtcatctccacaaagtgggcgtttgccgctttcaaaagctccttcagatgcgttactgactctttagaagttgattttccgggtgttaaaatgtaaaacgcattttcgaataaaaattctttggcggcagcggccccggatttatgagaccccgccatcggatggccgccgacaaattgataatgagccggaagcactttgtcggcgtagctgacgactttctgtttcgtgctgcccacatccgtaatcaggagttcatgggtgatgtctgatgcggccagcatatcgagcattttcagcgtttgggcgacaggcgtggcgataatgacaacagacgcttgctgcgccccttccgtcaatgagccggcccgctcgtcaataattccgagcttcagcgcggcagtgagctgttcttccgaaatatccacaccgataatccgtttatgcggatgctcctttttgatggccaatgcgatcgatccgccgatcagcccgatccccgcaagcaatatagtatccttcatttcactcatttcctttttcaactattttaatagagcaaagaggtgatgcttgatcacctcttataatatttcagctaagattgtgagaatttcctcattctgctctttcgtaccgaccgtaatccttaacgctgtcggaaatccgagcgcctgtcctgaacggacgatatatcctttttccaacagggcttggaacagttcatccgccggacggttaaaatcaatgagcacaaagttggtttgtgaaggataacaagttaatccgtgagtttccgcaaaatcataatactgcttaaggcccgctttatttttctcgacgcattcctgaataaatgtgtggtcgtcaagcgctgccagtgccgaagcctgaccgattctgctcgtattgaacggctctctcgccggttcaatctggcggatcagcgcttcgtccgcaatgccgtatccgacacgcagcgcggcaagtccgtacgctttagagaaggtgcggaggatcatgacattcggatattgctttaaaagcgggatgctttcagggtaatcgtccgccgtaacatactcgtagtacgcttcatcaagtacaacgagtatatgctcgggaactctgtttaaaaaggcaattaactcttgctcagaagtatatgtccccgtcggattattggggttgcatacccatatgactttcgtctcgccgtcaattgcttccagcatccggtctaaatcatgagcgccgtcactgcggagcggcacctcgcgcacctcagcgccttcaatcaccgcattgtgtctgtattgcgggaaagtcggggcggcggtaatcgtgtttgcctgatcatttaataaagaacggcagataatctgcactagctcatcagagccgttgccgaaaatgatcgaagattcactgacctgcagatgctcactgagccgcgttctcaaagcggcactgtaaccgtcgggatacagcgcaagctgctcaatctcctgatgcagcgcatcttttgcggcctgtgaacagccgaacggattttcgttagaagcgagttttactactttttcaagcccgtattccattttcacttcttctattggtttgcccggctgatacggtttcagctgccgcagctgttctttaatctgcaaatccagtcacctcattttacactgtacagtcgtccgaacgtcttcgcgtattcttcaaattcaagaagcgcatcagctcttgtgccgggattcacaagctttgttttaagctcttcaacttttttgacaagcgcgctgccgacaacgacaccgtcagatatttcattcatcccgtcaacctgtttgcggtttgaaatgccaaaaccgaccgccaccggaacagagctgaattctttcaccttacggatgaaagagtatacagacggatcgaattcgctgcgtacgcccgtcactcctaaagaggatacacaatacacaaagccgcaggcctgttcagtaattattttcaaacggtcttcacttgtcggcgcaaccagcgagatataagcgatgttctcctttttgcatgtcatttgcaaaagggcgctttcctctaatggaaggtcgggtacaagcaggccgtctatgtcgttttcccgcagtaaagcgaaaaagtattctttttctaattgtaacacaggattataatacgtaaagaggataattggaatatgaacgccgttttttttcattttgccgccaagttcaatggcttttacgatattcattccgttttccagagcccgttttgaagcccgttgtatgacgggtccgtccgcaagcggatctgtgtaaggaacgccgatttcaagggcagaagcgcctgcattctgtaatgatattgccagttcaacagaaatgtcaggaagcggatcgcccgctgtgataaaagggataaacaatttttcagaatctcgcagattaaacatgtgtctccaccccgttttccaaaacattcatcagcgtatgaacatctttatctcctcttcccgacaaactgacgagaatgattttgtctttatccatgtcctttgccatttcaaacgcttttgccagggcgtgggcagattcaatagccggaagaataccttctgtttcagaaagcagacgtaacgcggcaatcgcttcatcgtctgtcacgctttcgtacgttacacggccgcttttgtgcagataggcgtgctcagggccgatccccgggtaatcaaggcctgctgaaatggaatacggttcgataatctgcccgtattcatcttgtattaaataggtcattgatccgtgaatcaccccgagcgtcccttttgcgatcgttgccgcatgcagcggcgtatcaatcccttttccggccgcctcggcgccgatcagctcaatgtcttcgtctaaaaaggcctgaaatatgcccatcgcattgcttccgccgccgacacatgcaacaaccttgtccgggagcgttccttcaacccggcggagctgttctttcgcttcctcgccgatgattttctgaaattcgcgaacgatatacggatatgggtgcggacccactacagaaccgataagatagaaatgatcttcacaatgctggacccaatacctgattgcctcattcgtcgcatctttcagcgtgccgttgccgcttgtgaccggcaccacttccgcgccgagcagtttcatccggaatacgttcagcgactggcgcgcaacgtcttcttcacccataaaaaccgtacatttaaaaccgaattttgcggcggctgtcgcggcagccacaccgtgctgtcccgcaccggtttcggcgatgattttcgttttgcccatctttttagcaagcagaatctggcctaacgcgttgttaattttatgagagccggtatggtttaaatcttctcttttcagatagattttcgcccctcccaaatactctgacaccctgtctgcgaacgttaatgcagtcggtcttccggagtaatcaaacaatagttttttatattcggcatgaaaaacaggatcattttttaattctgtgaaagccgtttcgatttcctcaaggggccgcatcaatgtttcagggacaaatttgccgccgaattcgccgtatcttccgatttcatttggatatggatacatagtggttcatcctttcttctaaaagccggatcagtgtttgatccttgtgtccgtttttttcaattccgctggcaagatctataccgcacggacgcgttctcagtaagccggtaatcgtttcaggattaacaccgcccgcaataaaacagcgcttgcttgcattttgagcctgctttcggtacaaggggacacgggcccatgaaaacgcgattcccgtcccgcctctcattcctgtcactgaagaatcaatgacatagccgtcgacagcaggtgtaaattgagccatctgacggagcgtcccttccccgtgatggagcgctttccatatttccgagcgcacaagcggacggaggcgaagggcatcctcaggcgattcatcaccgtgaagctggatgacgtcaagtgccagatcagatgcgatttgcgcgatgttttctatcgtttcatttacaaatactccgacatgtttcttgtctgtccggacctgctctttccatttccggacctcatccggcgttactctccgtttgcttgcggcaaaaataaatcccagataatccgcttctgaagctgccgcaagttcataatcacgcttcgatcgtattccgcagtactttaactcaggctttttcatatcgtcactctccgaacagtccgcggatcgccttttgctgcgaatcctctctcattaaggattctccgaccaatacagcctgcgccccgtgcttgttgacgaattgcaggtcagccaaagaaccgatgccgctttcgctgaccagcaggcagccgtccggcacaagctgcgctattttttccgtttgcgaaacagaagtacggaacgtttttaagtcccggttgtttatgccgagaatgtccggctgaaacacttgtaaaatccgttcaagcacagtttcatcatggacttcaacgagaacgtccatgcccttcccgcgggcttccagataaagctcatgaagctttggaggttccagcgcttccccgatcagcaaaatggcatcggcgccgatcctgaacgattcctccacctgaagggaatcaataataaaatcttttctcagcacgggaagagacacggtttgtttaacatctgtcagaaattgatttctcccctgaaaaaaacgggtatccgtgagaaccgaaagggcgtcggctttagccgcttcataatccgccgcaatcgtttccggaacaaaatgctctttaatcaatcctttagacggcgaagcttttttcacttcggcaatcagcccgataaaacggttcgggttcaggagcgcttctttaaaggatctccgttcaatttgacaggtttccggcagcacgatggatttgatttcttcttttttctgcagaatgatttgatcaagcatacatttcttcctctttctgtttcagacgttcgagctgccttttggcatctccgttttgaatggcttctaaggctgttttcgttccttctttcagatcgtttgcaagacctgccgtataaatggccgcgcccgcatttaaggcggtaatatgcagagcggatgacggagctctatttgcaaaaatattctgaatgagaagcgcgctttcttccgatgaactcacttgaatatccttcaatgaaccttctgcaaaaccgaattgttcaggtgaaacggaatattccagacgttcaccgtttttcagctcaatgatatctgtcggtgctgtgatggacagttcatctaatccgtcacgcgccgacacaagcatgacgtgtctgacatcaaattgttccaaagcgcttgccatcaggcgcgctttatcaaatgaatagacgccgatcacctgccgcttcacctgcagcgggttgctgagcgggcccagcagattaaatacggttcggaagccaagctcttttcttgcggcggcgacgtgcttcattgacgaatgaaacagcggcgcaaacaaaaaccccatttgtttcatttcaatgctgcgtttgacgctttctggagtggcttgaatggaaacccccagcttttccagcacatccgcgctgccgcttttagacgaaacggagcgatttccgtgcttggcaactttagctccggcggcagaagctgtaatcgccgctgccgtggatatgttaaacgtagaaatcccgtctccgcctgttccgcacgtatcaacgacatccgccaagccacccgccgtctgtgcccgcgcccgcatcacttttacaaatccggcaagctcctccgccgtttcaccccggtgggctaataccgataaaatcccccgatctcagactgcgacatggccccgttcatcatcatctccatcagcttttcggcttctccggttttcagcgtgcggccattaacgcacgattgcagaaatttgttcatccgtcttctcctccctgccagaaaagatgtcttctgcgatttgaatcgtttttaaaagcgcccccgctttgttacagctctcttcatattcggcttccgggacggaatcagcgactattcccgcgcccgcctgcaccgacgccgtaccgtttttgacactcatggtgcggatggtgatacacgaatcaattgacccgtcaaatccgatataagcgatacatccgccgtaggtttctctggaagtcggttctaattcatttaaaagctgcatcgcgcggattttcggagcgcccgagagtgttcctgccgggaatgccgacatcagcgcatcaaccggatggacgccctgttttaaacggccggttacaacagagatgatgtgcatcacatgtgaaaaagaaacgacctttgtgaattccggaacggctacggaaccgtactccgcaactctgccgatgtcattgcgcgcaagatcgacgagcatataatgttcagctttctctttttcgtcattcatcagctcttttttgaggcgatcgtcctcttcttttccggcgccccttcttctcgttccggcaatcggatgaatttccaggtgtctgtcatccacgcggatcagacgttcaggcgaacttccgacaatgtctctgtcaggcagtttgatatagtacatataaggtgaaggattgacgatgcggagcaccctgtacagctcaaatgaatgtctggataccggaatgtcaaacttttgcgaaagcaccccttgaaaaatgtctccggcttttatatattctttcagtttattgacgccggccataaactcttctttcgtataattagatgtcatatcggcaaaacttggcgtttcaaatgtttctttagaaaaaaacggctctttcatatctttcggttctgtcaaaataccgataagcttacgaagctccgcgcaattttctttaaaaacggcccgcttttcttcctccgtctcccggccgttaagcgccgcatattgaatgaaatgcacttgtttcgtttcgtggtcgtacgcgatgattttccggcagacaaacagcatgcatttttcgaaatctgtttctttcgcgtggctcggcacggtaggctcaatcaaagggatcatgtcatagctcagataaccgacggcccctcccgaaaacgggatatcaagctcgggtgttttaatgcggaagctttcattcatccaatcaagcacggcttttaattctccggcttcaaacagcgtatgcccgtttggatcagcggcagtgaatgtgtgatgactctctttaatcgtgataaaaggatcgaggccgataaaagagtatctcgaccagcttgacgactcatccttgctttctaaaagatacgtaatgtttctgtccagtttttcaaccatctgaatgggtgtgatcgtgtcgaccgtaaaagtctctgcgattggaatggtgcggtgtgtcagactgtcctttaaaaataaagaaacatccgattgtaaattcatgattctcctccttacggtaaggagaatgagatgaagagtgagaggagtcttgcgtataagaaataaacccaaaagaaaggcttcttttgggcagaataaaaacgtgtttatctcagctcagctaaactcattctctgctaccctattctaaactcaactgttcaatatcttacttaccagctctatacacactcttgtgtatttctaagctttgtttatcgtattacatgtcagtattttttgtcaatgataaatccggccttaacacaacggctttttctaaatagacatgcttgatttcatcctgaggcgtatccgtctgaaccgtcatcaggacacggatacacttttgcagagcgccggtgacatccatttcctgcatgcacgtcaccgggacgtactgccacccggaaaggcggcggaccgcttttgccggaaatacggaatggatatcaggcgtggcggataacaggatctgtacaacgtcttccggcttgcatccattttgttcaatgattttttcaagcagctgctgtgttttttctaaaatttcttgttcggtgtcttgttccaccgttgttgctccgcgaatgccgcgtatcatcatgctgtttcctccattcgccatttgttcagcaaattttcgagctcatcttttgaaagcatgcagtcccgcgcttcccctaattcctttaacacgatgaactgtgtcatgcctccgcgcgtttttttatcattcatcatccgggcggagagaaccggcgtttcaatatcttgtctgatacttcccgggtagccgagcccaatcagccattgtgtgagttctttcctgttcatcttgcaacccgcaacctgttcactcacgtaaagggcaaactgcatgccgagggcgaccgcatctccatgagtaatccggccgtagccgtattccgcctcaacggcatggccgagcgtatggccgaaattcagaaaagctcttatgccctcttccttttcgtcctcacgcacgacggccgatttgattgaaattcctttataaatcatttcattcagctcagcgcttgtcagtccttgcaacgtgtcaaacgtgagaagtttttctaaaaaagcatgatcggcgataaacgcgtgtttgatcacttcagccatgcccgatctcagctcttgttccggcagggttttcagaagctccgtatcgtaaatcaccgctttcggctgataaaacgcgccgattaagttctttccgagtttatggttgacggccaccttgccgccgaccgcgctgtcatgggcaagcagtgtcgtcggcatttgaatgaaatcaattcctcgcataaaagtcgctgcgcaaaagccggtcaaatcacccgtcacgccgcctccgaaggcgatcatacatgaggagcggtccatatggaaagcgatcgcttccgtttgaatccgttcatactcttttagagacttcgcttcttctccgcttggaacgattacttttttcacgggccatgtttcgtttaaaagccggaacatctcatcgccgtaaagccggtcaacttcagcatcgatgacgagaaggatctttgtcagcggcctgttcagtgaagacaaaagagcagcggcctgtttccttatgccttcaccgatatacacgggatatgcggaggaagctgtccgaacctcaagctctttcatcagaattccctcgatagttttttcatgttttcaacattttctttaatgcggtcgatctggtcaagcccgaattgttctacgacggcatttgcgatttcccaggccactgcagcttcagccactacacttgctgccggaaccgcgcagctgtctgaacgttcaatgctcgctgtaaatggttctttagtttcaatgtcgacgcttttcagcggcttatacaaagtagggatcggtttcatgacgccgcggacgacaatcggcattcccgtcgtcataccgccttctaatcctccgagcctgtttgtggcgcgtgtatagcctttctcttcatcccatacgatttcatcatgaacttcactgccgtttttgccggccgcttcaaaaccgatgccgaactctacgcctttaaacgcgttaatcgacagaacggctgcagcgagcttgctgtccagcttacggtcatagtggacataacttccgacaccgacaggcataccttcgacgatcacttcaacgattccgccgatcgagtcgccgtttgccttcgcttcatcaatggctgccatcatttgacggcctgcttcttcatcgtagcatctcaccggtgattcttccgttacccgtttgagatcctcaatggatgtgtaatcggttttctctgcttttacgctgccaatttgcaggacgtgtccggcgactttaatgccaagctccgctaaaatctttttagcgacggctccggcagccacgcgaaccgttgtctcacgcgcggaagatcgttctaacacatttctcatatcacggtgattatacttaatagccccgttcaaatctgcgtgtcccggtctcggtcttgaaatctgacgtttcatttcactttcttcttcttctgtaatcggtgcggcgcccatgatttttgtccagtgagtccaatctttattctctacaacgagcgcgatgggtgaaccgagtgtccgggcatgccgcacgccgcttgtgatcttcgccctgtccgtttcaatctgcatgcggcgtccgcggccgtgccctttttgacgtctggcaagctcaaaattaatgtcttcttcagttatataaagccccgcaggcacaccttctataattgtcgtcagctgcgggccgtgtgattctccggctgttaagtatctcatttctttcttctcccttcatcgcattaacgcttttaagtaaaactataccacaagttttcattaaatgtcttctatcttttttgataaaaaaatgtatcagtgctctcaaggccgaatttttccgggctgaaaatctgctctgtgcttccgacaaacagaattccgttctttttcaggctgcccgccatttttacatacagctcttcttttgctttttcagtaaaataaataaagacgttgcggcagacgatcagatcaaaatcctgttcatagctgtcggcgagcagattgtgccgcttaaaccggatgtttttttgaatctcttgttttacttgataactgttgtcagcctgcttggtgaaataacggcttttcacggaagccggcacctcttgcagcgagcgttcctgatagatgccccgcttggctttgccaagcgccttttcatcaatatctgtcgccaatatatcaaatccggccaaacccgcctgctgactgagaatcatagccaaagtatagggttcctcccccgttgaacaggccgcactccatatttttaacggtttgttatgctttattaacggaagaattgaggtttcaagaacttcccaccgtttataatttcggtaaaattcagaaacattgatcgtcatcctgtccaatgtttcatttaataaaagcttgtctttctccaaagcggcggcaaattcctgaaaatctttgaatccctttttttcataaagggacgtcagccgccttttcatctgtgcttctttgtataaagataaatcaacgccggttatttgtttccacttggtgataaaaatttcgtaaggctccattgcttctctcccaatctcgctgtcttttgtcctagtatagcctgttttctttctaatttgtacgatttcaataaaaaaatcagcccgcaggctgatttgtgagaaatgaaaagacagggcagcgcagcctctgtctttcttaaaatatgtaaaccttttcataacaagagaaaaagaaaggctgacggcttagtacacccagtcggccattaatttttgatacggtacaagctcttcccgtttgaagaaaatgtcaatttcccgctcggcgctttctaaggagtctgaaccgtgaatgatatttttgccgacaaacatgccgtagtcaccgcggatcgtgcccggcagtgcatctttcgggttcgtttttccgatcagctgtcttgtgatctctactacattttccccttcccataccattgcaaatacgggtcctgatgtaatgaattccacaagctcgccgaaaaacggcttccctttatgttcagcataatggttttcagccatctgttctgaaacttgcattagcttggctcctgccaattgtaagcccttacgctcaaatctggataaaatctctccgatcagctggcgctgtacgccgtccggttttaccatgataaaagttttttccataagattctccaccccatcattatgtataggctttcaagttgcacaccgaaatcgtaacatctttctgacaattaatcaatccagggcggagaatgttcacatcttgttcgtaaaaggaatttaaaatttccgtttgccgatatatttggcgatggcggccaatgatgagcgcgcccgtcctctcggcagtgtattcagtttttcaaacgctttttttaagtacctgtcactgacggccattgatttttcaattgcgtctgtgcgtttaatattttcaataatgggggcgagctgctcctgtgttgtttcactgttaattaatttcagctgatttttcaattcaggctgacggagcgcgtacaaaacgggcagagtgacatttccttgcagcagatcccctccgaccggctttcccagttcctcttccgttgaagtgaaatcaagaatgtcgtcaataatctggtaggacatgcccacgtaatagccgaaccaatataatgctttgtgaatcttctcatcagctcccgaagcgatggcgccgagctggcagctgacggcaatgagaagagccgttttccgtttgatgcggcgcaaataggttctgaggttttgttccatattgtatttatctctgatctgttcaatttctccgaggcatacttctacgatggttttggacaggatccggtgggctttcggctcatccaatctcgtcatcatctcaagtgagcccgcaagcatataatcaccggtatacatggcgatacggttgtcccacttggctttgatggtcggttttcccctccgcagctcggcgtcatcaatgacgtcgtcatgcacgagggacgccatatgaatcatttccagcgtcaccgcaacatattttattttattaatgtcatagtcgccgaacatgccggaaagcaatacgaaaacagggcggatccgcttgcctcccgcctggagcagatggagcccggcttcactcagcaagggatagtctgaccgcaccgtttgctcaagttccctttcgatcacatcaatatcgtcatttaaaaaagaataggccattttaaatttcatatcattcacccaaacatctgtatattcatcatttccaaccgatatgcgtagcggccactccgccggtaaacgaatggtatttgacattcgtcaggcccgcttcttcaaacagacgcgcaagctctttcataccgggaaattctcttgccgattcttgaagccaagaatattctttatagctcttcgcaaacatttttccgaagaaaggcatgatgtatttaaaatatagaaaatatgcctgtctgaatccgaacatttccggctgggatgtttccagacatacaacctgcccgcccggtttgacgacccgccgcatttctttcagcacggtcagatagtcgggaacgttccgcagcccgaagccgatggtgacaaaatcaaaagaatcatcagcgaagggaagctccatcgcatttccgtgcaaaagctcaatttggctgtaaccgccctctttcacttttttctcgccgatgctcagcatatttttgctgaaatccagtcctttgatttcgccgctttttccggctgcttctgcgagggcaatcgtccagtcagccgttccgcagcagacatcaagcgcttttgcgccttcttttacattcatgatctgcatcgttttatcgcgccattttttatgctgctgaaaactgataacagagttcatttggtcataatttttatagattttttcaaacacgccgtgtacgcgctgttcttttgactcctgcatgttgattacccttcttccactttctgatgatatgttttgtcctggctgatcgctttgagccggttcagcatgaggttttggattggtgaattgagcggcagcagcgtttcaatgctttgctttgcctttcggaagctatcttccattatgtcagcctttgatttccctgactttacaatattgccgatgacatcgagaaatatagcattgccgttcatcagccgcttatatacaaaaaaatcactcgccagctctttccagcgcggaagattaaagtggtctgacactctgtgaaacagggccgcttccacaatcgccatgctttcgatcaattgattcaagtcattgacagaccgatcgtacagacggattttatgctcattgatttctttaattgccgtagcgagcgtccgaatcatatagatatccttcatttcagataaaagcgaataatacagtccgctgaaatagtcgccggcaagcacggtgagctgccggtttttattttcgtctcgctttaacgctctggctgttgtcacttcatcgtgggtatcaagggcgctttggacaagcatcgcagttactatgtaattttctctgtcgttgttcttaatgtccgcctcttcaaacaaagcgtgaaaaagaagaagcttatcctcatcgattttaggcgcggaaatatgtttcgctaaataaggatgagacagcttttgttttaatttcgtatttagattcgttaaagttccgtagatgtcttgcaaaaatatcacccttgtccccaaattcacatttattctaatatgtatgagatttactcgtcattattatacgcaggtatcattatagcataaaaaaaagaaattggctgtattctcccgccgtttgcgggcaattggcaaaagcgggaaacagccggcttattttttttcgctgttcatttctccgtaagcggtctggatgagggcgttgcctctcactttgatggcagaggtatgctcagtaaactgagcgataatcacttcgcctttgtccagtttttcggaatggtgaaatttcgtatccgtacctctcgttaaaccgatgacgttcacgccgtcctcgaccgctttaatgacgacaaaatcacttgaatgctttgaattcatatctgcaccctctatcattattaatccgcacgtttaatatgttctaacacttcggaacgcgccgctgcgtcatctttaaaaatacctcttacagcggaagtcactgtttttgcgccaggctttcttacgcccctcatcgtcatgcacatatgctcagcttcgacgacaaccatgacgccgtggggatctaaggtctctacgatgctttctgcaatcgttgaagtaatgcgctcctgcagctgcgggcgttttgagacggcttccaccgcccgcgccaatttactcaggcccgtcactttgccgccgcgcggaatgtaggcaatatgcgcttttccgtaaaaaggaacaaggtgatgttcacacatggaatgaaacgcgatatcttttacaagaacaagctcctcatgctcttctccgaaaacggttttaaagtgttctttcgggtcttcatttaatcccgagaatacttccgcgtacatttttgccacgcgtttcggcgtatctaaaagcccttcccggtccggatcttctccaatcgcctctaaaatctggcgaaccgcctgttcaatctgttctttattaacttctttcattgtctgtgtcctccaccattgaatacatttaatttcgattctagcacatttgccgcgccaaaagcaaaacgaaagtcctgcccggtgaccggggctgcttaaatatgaaaagcccctttatcaaggggcttttctgtgaagaaacaaagtgtatgtatcagatgcatacacgatctatattcacaattattttcctgcaacagcgtctttaagagctttacctggtttgaaagcaggtaccttgcttgcagggatttcgatttcttcacccgtttgcgggttacgtcctttacgtgcagaacgctcgcgcacctcaaagttaccgaaaccgatcagttggattttatcaccgtttttaagtgcatctaaaatcgtatcaaaaacagaatcaactgcttttgtagcgtcttttttagacaattcgcttgcttcagcaaccgcattgattagttctgtcttgttcatgcctttcacctcctcccaaaagggtatcaaatcagcagtttattatcatttcttcacagttcagcctgattctaaacctgtctgataaaaaatcaaagcagggaagaacagacaagtaaacggcttttcataagaaaacagacactttgaggaatgtttgtccaacaaagtgaagattttctgtatgtagagtaacacatataaaaagccatatcaagcattttaaagcctcaatcccttgctcgtcaaggttttcacgtgttttaccgaacaaatattcctttttttgcttttttcctcctaatccttgattgatttccagtatctaaaaagaataaaaaaagaccccccgtttcaggaagaggtccttcagcttacaaaataatggcgatcaggccgcctgagccttcgttaataattctctccagcgtttctttcagtttgtatctcgcattttccggcatgagtgacagttttgcggagattccttctcttacgatagagctcaatgatctgccgaaaatatcggaattccagatagaaagcggatcatcttcaaagtcctgcattaagtagcggacaagctcttcactttgtttttctgtcccgatgatcggtgcgaattcactttccacatccactttgatcatatgaatggacggagcgaccgctttcagccttactccgaaccttgatccctgcctgatgatttccggttcatcaaggctcatatcggttaaggccggggcggcaatgccgtagccggtctgtttcaccattttcagcgcatctgatacctgatcatattcttttttcgcgtgggcgaagtcctgcattaattcaagcaggtggtctttcccgcggatttcaacgccgaccacttcttttaaaatctggtcatataaatgatccggcgcatacaaatcaatttctgcgacaccctggccaagttcgattccggccaatccggcgctttcaataaactcaaattcactgaagtggccgacaacccggtcgacatcgcgcaggcgtttaatatcttttacggtttctttcactgattcctggtagctctctctgagccaatgattttctttcagcaccatgacccagctcggaaggttgacattgacttccagcacagggaactcgtaaagcgcttctctgaggacgcttaacacatctgtttcccgcatgctttcaacactcatggcgaggacgggaatatcatatttcgcgcttaattcagctctgagcgcttctgtttccgggtggtacggttttaccgagttgatgaccataataaacggtttgccgacttccttcagctcgtcgatgactctttcttccgcttccacgtaatcgccccgcgcaatatcgccgattgagccgtctgtcgtaatgacgaccccgattgtggagtgttcctggatgacttttctcgtaccgatttccgcagcctcatgaaagggaatcggttcttcataccaaggtgtattgatcattctcggaccgttttcatcctcatatcccttcgccccgggaaccgtatatcccacacaatccacaagacggatgttgacatcaagtccttccgcgacatgaacggacatggcttgattcgggacaaattttggttctgtggtcattatcgtttttcctgctgcgctttgcggaagctcatcctgcgcccgcgctcggtcggcctcattgctgatattcgggagcaccacaagctccataaattttttaatgaatgtagatttccctgtacggacagcgccaacgactcctaagtatatatcgcctcctgttcgttcagcgatatccttgaaaatatcgaccttttccaagtgatcccctcccggacttcctatccttatcatttttcattcaccattctccaatcaaatacaggacactatatgtgtatgacgttgtcctatttcaatatgacatctttagaaaattttcaggcagtcttttctatcaaaatcaaaaaaacctttctccctatttgtatgcgcgggaaaaaggttcattcctgtttcgtttgactttctaaaaaaacgggttcctgtttttcatttacggtgtaagtgactgaaaaggccgggacgaaaggagtctctttccataaaatatcctgaatttccgcgcccggtttgattttctttttgttttccttcaggcagcgggcgagatcgacgcgatagtcggcatagatttctccgtcagcgccgattaaaagcggcagagacgtgcctgaaaccggacttttgactgaaggagagtctttcatgccgagcttttttttatttaaagtgaacaggccttttgaaacagcgtcctcatagggaggatatgtatgcttttcctgatacattttgacacgcagcttcatgtcgcggattgcttccgccatttggagatcgaccagcttgacggtaggcttattttccacatcgacaagcacgtattggtacattcctccgctttcataagctgaggccggcggctcctctatgtatctgggcgcgagccgcttaaaatctatcggatatttttgatagagcggtgttttcatatcttttgtctgaatcggcagaagtccgccgttcgcctttttaaattcatccactgccgcttgcacctgctgaagctgatgtttgtaagatactttattttcagttttttttgcttcagggtacagacagcccgacagcagaagcaccgccattgccgttatgacggccatttttaacttatgcattccgcgcccccttttggctttattcattgacaggcccgctgaaaacgaccattaacacgatcaatcccgagatgaccatgcaggcataagcgagtgaagaaaccgctgcttttatcagtttgtttttcactttgtacctgctgacataaataaaggcgaccgcaacaaacattaatcccatagcaccaagcgcaaaccacattttcatcaatgccacactcacgttcgtgccccccgtcccatcattgtaagcgttatatttcattttaatatacaaatgttgaaaagatcaacaggttttccatctattgaaaaaacaaaaaaactgaagcaaagaggggactttgcttcagtcaagttgactatattcacctgtacgtctgagatacactctcttggacttcgatgctatagtatgcgtagatgcgtacgtctgcatcctcttctgcctaaatcagcaaatgttttaagcgatttcagccggagagttctgcgttttggactttcgtcacttcagaatatgctgacggcatgttattgtcacttcacccggttttcgaatgtgttgaccaagtcttccatctcatgggttttcactctggccattaaggattctacggccgtttctaccttctgcccattaaataatacttggtgaagcgcttctgtgatcggcattttcacctgatatttttgagacagctgatacgcagctttcgtcgtccgcacgccttcaacaaccatccccatcttatccaggacagcttccagcttatatcctttgccgagcaggttgccggcgcgccagtttcgggaatgaacgcttgtacacgtcacgattaaatcgcctacgccggtcaggccggaaaaggtgagcggatttccgcccatctttgtgccgagtctggcgatttcagcaagacctcgggtgattaaggccgcttttgcattatctccgtatcccaatccgtctgtaatccccgctgcaagagcgatgatattttttaacgctccccctatttcaacaccgatcatatcgggatttgtatagacgcggaaatgctggttcatgaataaatcctgaaccgcttctgcagccttgatattttttgaagatgatgtaacagtcgtcgggtgtcttaatccgacttcctcagcgtggctcggccctgaaagcacgacgatgtcttttctgtactcctcaggcagctcctcctccattaattctgaaatgcggagaagcgaatccggctcaattcccttgctgacatgaacaaaaatcgattgtttcgggatatacggcagagcctttttcagcacttcccgaatggcttttgtcggtactgccacaatgatgaagtcagctccttttaaagcctcgcttaaatcggctgtcccgatgatagaacttgatagctccacacccggcaggtaatctttgttttcatgcagttcgttgatttgatcgatcaattcggcacggtgtccccacatcatgacttgatgtccgttatcagccagcactaaagaaagtgcagtgccccagcttcccgctccaagcattgccacttttttcatctctgtatcacacctttttattttcttgctcttgcaaatattttaattggcgtaccttcaaatccgaaagcgtcccggattcggttttctaaaaagcgttcataagaaaaatgcatcagttccggatcgttgacaaaaacaacgaagctcggcggcttaacagcgacttgagtcgcataataaattttcagacgggagccgttgtgcgtcggagtcggattcatggcgaccgcatccatgatgacatcatttaagacatttgtctgcacacggagagagtggttttcactcgctttaataatcgcaggcatgagtgtatgaatccgctttgtcgtcagtgccgacataaacagcaccggcgcataatcgagaaattggaaatgctcccgaatattctgttcaaattctttcatcgtgcgctcgtccttatcaacggcatcccatttgtttacgataatgacgacggctttcccggcttcatgggcgtatccggcgatccgcttgtcctgctcaaggatgccttcttctgcattcagcacaacgccgacgacgtctgagcggtcaatggcttttaacgcccgcagcacactgtatttttctgttgtttcatatactttacccttttttctcattcccgccgtgtcaacgattacaaattcctgctgattgtaagtgaacgccgtatccacagcgtctctagtcgttccggctacgttgctcacgataacccgctcttcgccgagcatcgcattgacaagggatgattttccgacattcgggcggccgatcaggcagaattgaacgacatcatcactgtacttcgtctccggaatgtttttaaaatgctcggcacaagcatcgagcaaatctcccaatcctaaaccgtgtgtccccgaaatcggatacggttctccaaagccgagcgcataaaagtcataaatgttcgctctcatttcggtattatctaatttattaacggctaatacgaccggttttttcgtccggtacagtatttttgccacttcttcatccgcagacgtcacaccttcgcggccgttcaccataaagatgatcacatcagcctcgtccatggcgatttcagcctgctggcggatctgtgtcagaaacggctcgtctccgatatcaattccgcccgtatcaatcaggttaaaatcataattcagccattccgccgaactgtatatccggtcccgcgtcactccgggggtatcttctactattgaaattctttcacccgcaatccggttaaagattgtggattttcccacattcggtcttccgacaatggctacgacaggtttacccatagtacccttcctttcaatccagccgcttacattttcacaaaaaattgttcaaccggttattaataatcatcttcgctatgaaaagaacccttcaaacagaagggcttaactcatttattatatcagttttcactgagatcacaatgtattcttcaaaatgtttcgtattcatgtaacagtctccgtctgttttcaagacatttttgtcgctcctttgccctgctttttgcttttttggctgatgcgcgccgcaagctgttcatatgtagtcagcccgacgagaagaatcactcccgccgaacagcctgatagccatttataatcaccgacggctgctgcccccgcaatgttgcggatgaccgcagcatacaataactccccctggcacatgccgagaacaaaaagacaaagcctctcagggaaccgcccctcaacagaaagcgtaataacggtaagcagtataaccgctgcccattcaggttttatgataaaccaaacagggtcatataatgcaaaaagaaaaataaagccgtacgccgcagccgccgtcagatgaatcacaatatgacggagccgtttatgcatgccgaggcttcccgcataaacaaatgccgcagcaaaaaacatgacatatgccgcgttcagcgtaaaataagccgttatctgatgtatgcttgccatcatattagtcaaaataaagactgatacgtaaaaacggctttttgttttggcaaaaataaaagtcgcaagtatccataaaaaccacattgaccagtaataataaaacggttccataatcgctcctcctctgaccagtatggagcgggaacgcattttttaaaccaattatgcctgaaaggagcggataaaaatgggaaaagacagacaggagaaaaaactgaaagcctcccgccgggtggaatctgatcgcgatgattcaattcaccataaaggagcgacgagccttgaacaaaacggtgaattccgaaaaagaaaatcgtaaaaaacagagaaaggcatgcgggttcgcatgccttttaacgtctgctgaaacgggatgtgtcaattccccgttcagaaagccagtgatgtgtgtcaccttttatgaccaaaggcgccttttgcaattgggcaaccgattggcatccgagggcggtcataatcattttcagctcttgtaaaagcaccgtcatctcgtcaaacagcccctcttctcctttggaggtgagagctttcaggaaagtgcctgccattcccgcgccagaagcgccgagggcaatcgatttggcgacatccagggcactttgcagcccgccggatgcgataattgattgatcagcggagagcgagtggatttccgctaagcttgcggcagtggaaattccccatgtattaaaaaattgaagcgccttctctctgcgcatattttcaatcttagagaaatttgtaccgccgtatccgccggcatcaactgctgccgcaccggcatcaaataactgccgtgccgactccctgctcattccgaagccgacttctttgacaaaaacgggaactcccgcttccgccgcaatccgctcaatacggccgagagcgccggtaaagcttctgtctccctccggcatgacgatctcctgaatcacatttaaatgaatctggagggcatccgcttgaatcatatcaattgctctttttgcctgctcggcatccgcctcgctgcctaaattggcaaatatcagcccgtccggattctcttttctgacgatctcgtaagaataccgttcggagggatcttttaaagccgacatttgcgaaccgacagccagcggcatgccggctttgcgcgcggctcttgccagcgatctgttaatttcgtatgtaagctgtccgccgccgcctgtcatcgcattgataaaaatcggcgaactgcttgtgagtccgccgattttcgttgatatatccactttttccaatgctaggttcggtaggctgacatgaacaaacgtaatatcatcaagccccgtttcccggttttggccggtagacagcgcatgatttatatgttctctttttcgttctgctcgtgtcacgttttatcaccaatttattttaatttattaagcttgtctccgattaaatcgccaagctggaagccggtgctcggctcttctttcgcctggtattgacggaagtcctcctgatcggctttcggcgcttcttcaagctcacgcatgcttaaggaaatgcgctcttcgctttcgttcacgtcaagcactttcactttaacagtctgtccttcttcaagcacttcatgcggcgttccgatatgtttattggaaatttgcgaaatgtgcacaagtccttccacgcccggaagaatttcaacgaaggcgccgaagcttacaaggcgctgcacttttccttcaagcacatctccctgttttaccttttcgccgatctggctccaaggtcccggcagcgtttctttaatagataaagaaatacgctcgttatcgcggtctacggacagcactttcacttttacgtcctgaccttcttccaccacgtcagacggtttttcgacgtgtgaatgagacagctgcgaaatatgaacaagcccgtcaattccgccgatgtcgacaaatgcgccgaaatcagtcagacgctgcacttttccttcaagcacgcttccaacctcaagcgtttggagaaaatcatgctttttggctgtctgctctttttccactacagcccggtgtgacagaatcacccggtttttatcacggtcgagttcaacgacgataagagagagggttttccctttatagtcagtgaaatcctcgacgaaatgagcttcgacaagtgatgcgggaatgaagccgcgaacgccgatatcaacgacgagaccgcctttcaccacatctttcacttcagcttcaaacacttcttttgtgtcgaattttttttcaaggtcttcccaagcgcggtcagcatcaacggcacgtttagataaaatcaaagcatcgtcttccacttttgttactttcaggtcaagctcgtcgtcaacttttacgacatccgatgctttctctacatgaagacttgataattcactgattggaatgattccggactgtttgacattgacaatttcgacatctacatgcttgtcctctacctttgtcacaatcccttttactacatctccaacctctggcacttgaacatcaatttgattcatttcctctgtcatttgaataacctccttggtccaaacctacacagcttaattaatacggtttgaaagctgaacatgtgaatgtccgcttttcagccgaatatgtattaaagaatcatccaaaaaagattttgaatgatcaataaaaagttttattagtattaacttctaataaaaggactggtttgtcaagcaataacatcttgtcttttgaaaaaaattaaaaagcgctccgcccgaagttaacgtgatttctgttcgacgatctccagaatttttcctgcgacttcggcaatgctgagtgacgtcgtatcgatttcaatcgcgtcttccgctttgcgcagcggggaaacttccctctctgaatcgagtttgtcgcgtctggcaatttcttcaatgagcgtctcgtaattcacgtcatagccttttttcttattctcttcatatcggcgcttcgctctttcctctacggacgcgagcagaaaaattttcacttcggcatcaggcagcacgtgagtaccgatatcacggccgtccatgacgacaccgcctttttgtccgagctgctgctgtcttttgaccatttcttctctgacgcctttatgcttggcggcgatggatacttggttgctgacttcgtcttttcggatttcttctgtcacatcttctccgtttacgagaacgatttgtctttccggagcggatacaagctcaatttccgtacgcttcaaaagctctgtaagcgcggcttcatcggttaaatcggcattctgcttgagtgccgtatatgtaatggcacgatacatcgcccctgtatcaatgtacacatatgattttttctcagctactattttagcaacggtgctttttccggcagcggccggcccgtcgatcgcaattgataatttcttgtccataatctctctccttgctctttactcctctatggattgtatcatgaactgccggaaaaggggcgaaaaaattgagctgatttaccgctttaccgtttcaatccattcttttttctccattttatcaactccctcatatttcacagctttcgaaatataaggttcaataggctgataatgaagcaaaaactgcaccgcgcccaaaattataagctgaatgcagaccaatttgaccagcagacgttcaaatgttttcatacacgcgcacctccattaggattagtatggaaaagtgcgctgctgtttattccgacagactgtttcttctctgctgcagctgcgcgcgcatacaatattggagtaaaagctgctgtgctgcggggccgatttctgtaaattcaagcgtcattttttgtttatccgccttttcatcataaaaaatccgctgggtaagagcctcggccgttatatccgccccattttccttgccgggaagagaaaatgagacatacagcttttcacctggttccgcggaaatatgctcaggcatcacaacagcgattccgccggcgctgatattagaggaaaccgtttgaaaagcggtttttttcgcttccaatttgacggatacatccaatactgcgtctgcacggacgtatcggcgtctttgaatccgcttcatttcctcctgagggggatgtccaatccgatcatcgggatgggttcttttttctttcctttaattatgcttttaaattgatacggtacttggccattccccataaattccgctgttatttccaatcctttatgcaaaaagaccgtccgtcccgaatccagatcgacgggatatgagatgtggagttcgccgttttcaacgcttactgctttactcctcgcttttttgggctcattgttctctatgtattcaatccaaatataatctccgacagctatcatggccttcactctttcattatttatgcttttattaaagcatgtaatgaaaaaaaggaaaagacttttagtcctttcctcctttatttttataggtctttatatataggctctgcgctttttaatttttctattttttcctcttttccgtcgtccgcattaatgaacatttgatacgtgtctttcccgatcgtcccgagcatttcgtagcaaagcacttcctgaccgagttcattcgtgatcagcgcctgccgggtctcccgcacttcaacatttttattcagcttcgctttcgcttcatcagctgacaaagcgggagccggaatcgttctcgtgcggtgcgccgccaggtaatcacgcgcggaaaaaccgacgacttcaccatcatccagcgccactttcattcggatggcttccggataaatgcggacgtttttctccacgggaataaaagaaaagacgccgatgttattatattgcgcgctttcatcaatttcgagaccttttgtttcatatccgtttttctttaaaaacgcgacagcccggttagatgcttcattgaggctgatcttttgtttcttcacggcccgtttttgaatcaaatagacaggatgtccccctttttgggtaatatccatatagataaaagatttgtgatccgcgtcattcatgcggatactgtatacatcgcgattcgtcttccggccgcttttgaccactttaatggaataattatgatcaggcgcaaaccgttgtgcgatttttaccgcttctttttccgtaatttgttttcctttcagatgcgtaaaaccttttcgttctgtatttgctcccgtaaatgtggggctgatgctgtcttcagaaaaagcgcctacatttttttcgactgttttaaagctgtcgacgatcgtattatcgctttgttttttgtcagaggcgagcgccatttcaacatccatccaccgtaaatttttgctcatgacgagatgctgaacgctgcgaagctggttttgaatgttctccgcctgtttgtacaggctgttcagtgttgtatattctttcttatcaagcggtttttggtctaaatcccggacggatgttttatagctgaaatctcctatattggataaaaactcctccgtcttattaaaaggcatgagagtcaggggcagctggctcacattgttatgcgcttcagatgtaattctccatacatcaatgagcgccggagacagagattttttactgttcatcgcaagcgtcgtcccgattttgtcgtgaagctgatcaacatggtacgtcagttcatgaaaagccctctgataattattttccgcgtgcagaaggaccgcatctttttcctgatgctctttatatccccagtatccggttgcggcgatcgcgacaccgagaacagcgataatgattcctctaatcatgttaacacctcattttgcgtacttttactcacagaaaatgtgctttccgattcttttaatctgcggacgtccccaaatccatttgcttgtcgccgtatcaggattgaaataataaagcgcgttttcagaagggtcccatccgttaatcgcatcaagaaccgcttcttttgctctttcattcggctgcatgtatatttggccgtcggcaacggcggtaaacgcgagcggttcgaaaatgacgccggccaccgtattcggaaataacgggcttttaatacggtttaaaataaccgcggcaatggcaacctgtccttcaaacggctcaccgcgcgcttccccgtacacagcctgcgccagaagattgatgtcgttgtttgagaaaccgccaggcatattagccgctgtcgtattttgcttttgatttgactgaccgcctgtattgttttgcggcttttgagcaggcttattcgtttccgcaggcttctgcgctccggctctcggttttgtttggttttccaatgggacgttgccataatgagtgaacgtattccctttttggatctgctccattacatattcacggtaatattttgattttgaaatcagcacctgtttggttttcgccccgacgaggccgtcaaccggcttcatgccgaatttctcctgaaaatttctcacggcccagtatgtggtccagccgtaaacaccatcgattttcccgttataaaatccgttatattgaagacgggcctgcaattctataacatcatcacccgtcgcgcctctttgaatcacttgatttgaaaacgcatgaaccgtttcatgatgatcgaagaaagcggcggcgaaagaaaatagaatgagacatgccataaaggctcctttgcacttcatctcttcaagcctcctactgcaaaatttaaagtgtacccgtattgtctgtcacgcggatatttttatacaccgtttccttcttatccctcatcaaggcataaaaaaagaaaccgcacgcgatgcgcggtttcttcacacttggatcatattgacggagcgtgctttttttgcctttcgcagcccgaaccaccataaaaacagcataaacggcagcatataatatacccaatgattgagggcggtaagaataaaatcgtaagaaccgtgcagacatgaaggcacggccagcgaaatcacaagccatttgacacgggcttttttctgcgaaaagcgggcttttccgagataaaatcccataatcactccgatcagcgcatggcaggagaccggcagaagcgctcttataaaagcatgctcaacgccgtggccgaataaatacagaatattttcaagcgtggcaaagcctaaagacacactggccccgtaaacgattccgtcataatgctcatcaaaatgagcatgcgggtacacactgatcatcagaacgaaccatttcaccgattcttccaaaaatcccgaagacaaaaacgaaacgaaaaagcttcctccccccacatgctctttttcaagaacatattggataaacatggtcggaaacacaaggacaaccccgagaaaaaaagacctcagcaccatatgtacaggttcattgtcatactgatcttttaaataaaaatagcttaacagcgcaatgccgggagcaattcctgcagagatgattgcaaacatcaggcaacctctttcctttatattcctatatctatggtaccatgttgttcatatttttacatctttcaattttttaaaaaagagcatatgaatgatcatatgctctctgcacccagccgttttgatatttcgtttgcgatcaagccgccgtgaaaacggccgttctcgataaaaatttcattggcgttatttccagccgcaatgactccggcgataaaaacaccgtcaacatttgtttccatcgtttcttcccggaaaaacggccggcctgattcagcatcaatctgcacaccgattttttcgaggaaaccgtgatcgggatggtatcccgtcatggcaaatacgaaatcgtttttcagccggaccgtctcatttcggccggagcggaaaatgatttcatcttccgtcacttcttcaagacaagcgccgaattccatccggattgtgccgtttctgacaagggcctcaaactcaggcagaatccacggcttgatgctcggggaatactcatgtcctctgtagagcaccgtgacgcgcgcaccggacttcacgagttccaaagccgcgtccacacttgagtttttcccgccgatcacagcaacatctttatcaaaataaggatggccttctttaaagtaatgaaataccttaggaagcccttcacccggtatgttcatataattcggatgatcataatatcctgtcgcaatgatacaaaacggagtgaggtagcggtcttttgacgtttctacaagaaaacggccgtcttcctgtttcgttacgcgctccaccgtttcaaaggcgtttacgcgcagctcttttcttctgacaacctctctgtagtaagagagagcctgtattcggaccggttttctgttttccgtaataaaggcgacatcgccgatctccaatttttcacttgaactgaaaaaagtttggtgcgtcggatagttataaatgctgtttacgacattccctttttcgatcacaagcgcgttcacgccaatttgcttcagatgtatagccgccgataatccgcaaggacctccgcctattataattgctttttcttctgtcatgtccttcaactcctgcgattggcatttccatcataagtttccactcatataaaaaatctcctatattatcataggagattttttttgtttatgcaaacgattggtttatatccagcctctgaaacgcgaagcctcagccattttccgcacgccgaccatgtaagccgcaagcctcatgtcaatccggcggttttgggacatttcataaatattattaaacgattttatcatcatattttccagtttttcctcgacttcttcttcactccagtagaagccctggttgttttgaacccattcgaaataagaaaccgttacaccgccggcgctcgccagaacatcgggaaccagcagcgttcctttgtctgtcaggattttcgttccttccagtgtcgtcggtccgtttgccgcttctaccacgattttcgctttgatgcggtcagcgttttcttctgtaatttggttttcgatcgccgccgggacaagtatatcacagtccagctcaagcagctcctgattcgtaatggtgtcattgaaaagcttcgtcaccgttccgaagctgtctctgcggtcaagcagataatcaatatcaagaccgtccggatcgtaaaggcctccgtacgcgtcagaaattccgacaactttcgcgccggcgtcatgcataaacttggccagatagctgcccgcatttccgaaaccttgtacgacgacacgcgcgttctgaatatcgagaccttttttcttagccgcttcttttatgcagatggtgacgccttttgccgtcgctgattccctgccgtgggatccgccgagtacaagcggttttcccgtaataaagccgggtgagttaaattcatcaattcttgaatattcatccatcatccaagccataatctgtgagtttgtaaatacgtcaggtgccgggacgtctttagtcggtccgacaatctgactgattgctcttacatatcccctgctcagcctttcaagctctctgaatgacatatttctcggatcacaaacaattccgcctttaccaccgccataaggaagatcaataattccgcattttaaactcatccagatggaaagtgctttcacctctttttcagttacattcgggtgaaaacgaatgccgccttttgtcggacctacggaatcattgtgctgcgcacgatagcctgtaaatattttcacagacccgtcatccatccgaacaggaattttaaccgttaataatctgagcggctctttcagcagttcatacacttcttctggataccccaatttttccagagctttatgtattacggtttgggttgattttaatacatcatgtttgtcttcttcattatgaccggtgaatcgatcggctgccatttgagttaacctcctaaaatcttctgtttctctcatgctccctttcagtgactagtatacaccttcaatatctccgtgcatagaagaaagacaatgatttttccattatttcgcttaaaaaaagacggccgctgaaaacagctgccgtttcaaatcttttttatgaaaaatgtttctggatggtttccacagcattgccgtccatgatgagttttccgtactcatggagcctgtaaatcgtaattgtcgccgggtgtccgtattcagccagcaccgcgatgacaccttcggcggaacgggagccgaggtcttcaaggcttacatagtattggttctcataatggtagacggtgccgccggtaatcccgatgcggtgaaggcttccggcaagctgaatgatatcttcaaacgaatggaactgataaataatatccgggctttcgtcaagtttgacctgcatctcgatataatcatcgtcatattcgtcatcttctgcgtccgcgtcatgatttttcgttacaatcacaaccataccttgtgcctgaagagaatatacttccaccgcgatcggaccattcgcttcaaagccgagctctgtatttgcttcattcatcatatctttaaataactggtggactttaaacgagtccttccagaggtcttcttttgtcagtccccgatcagtcagatcgtcgagggttaaaaagattttaatcttattatagttcagacgctcaagccgcataatgttccctcctgcctcttcttgcacacaaatcatataacacagtatatgaataaatgagtcataggttcttaatttgttatcagtttacaccgtgtacagcgggaagacaagcagaatgccgttttttatcaccgcggccggatttgtttcaggaaaacggctcatccggcccgcacagcgtaatcatatgcgtctccggcttcgccccgagcctcagcggaacttttgtcgtcccgtagccgttgctgatcagataatgcgctttttttaccgttcccgccccgcccaattcgtacggcccgaaccggccgaaacggatttggccgccatgcgtatggccgctgaacacagcgtcaatcccgtctgactccctcatctgctcatggatgtcggggttatggcaaagcagaaggtttactttatcagcatccgtatatctgattgcagcttcgtaatcatccatcatcatcctgatatcatccaccccgcagatcgtaacggtttcccctttataagcaaactgaaccgattcatttctcagcggaatcactttgtatgcccgtaaaagtgagagcaatttttgctggctgacctcgtaatcattatttccccacacataaatgacaggcgcgagagccgtcagacgtttgatgttttcttcaattctggcgtaaggaactccgccctccgccaaatcaccgccgagcaaaacggcatccggcttataaactgccgcttcgcggagaagcttttcatcaattaaacggcggtgcacgtcagatataaagaagatggtgagcggcttcatccctttcattttatcaagcgtaaatgtatgtgttttcagatggctgccgtttgccgttttgtacatgacggccgccataaccgcagccgctcccgccaatgagccgagaattcccgctgttagcttcataaacgcactctccattctgtcattgtcttacattagacggacaaacaaaaaaagacgtttctatcctttccggaaaacgcctcattttatttgctttcaaaataaagattgatatcataccgatgtttcatcaagtgaaaaacagattctctcgccctccatttttcaggctggggccataaatccgtgcttttttggataatttcacatctcagtttatgaaattcaccctcagctttttcttccttttttttaaaataataagaagtgcaatacgcaaaagcggaagccataatccagcacaaataaaccgtatggcctaatatttcctgcagaatcagctgcggagaggcttgggggcattaaagcttttaaacatcagcagtatgcacatcagggaaaaacaaacgagggacgcccactgccatcttcggcattgtgcggcataattttcgtattttaatttccgtttcaccagcgcctgaagcatttgtttcgtcggtccgtcagcaaatcggtctaattgcttccataaagaatccatgcgcttcacaccttgtccgttttcattagtacactatatgaaaaacgcggtgaaaacatgcatttattttaatcagacagcggaatgttcagaacctggccggtgtacacgtcgtttccgtttaatccgttgtagctgcggattttttcttcgcccgcccggcttttataatatttcattgaaatgcggtaaagcgtttctttcggctgtacagtatgctgtacggtccgcacttttttcgggacagtcccagcttgatcacttgcggcagccggagccgctttttcacggacagccggcggagactgctgttttgtctccgcgtattcggtgtctgtcggctttacttgtttttctgaggacgtttccgttttttcaggtgttttttcacttggtttttcttttgttttttcagatgcagccgcttctttcttatctttgtcgtcagacttttttttcggttgttctaaaagagcggtttctgacgtatctttctgagcgcctttcggaataacggcaggcgcgctttcactgtggtctatgaagacatcttcatagtccttcgggtcaaatctgctgctgttcgtcatataaagaagaccgaaaaagacaccgattgttacgataatgaacaggacggtcagaaaagtgaacagcggcgtttttgttttggttttttccttcacctgctcttccttttttttacgctcctcttttacagattgtcttgtcgggaggctgtcttcaagatattcaatttgttcatccgcggccgcggcaacctgctgctcggcacgctgctgagcttttcttctttcaactcttgacatttccgtcatgcaaacccctcctaacatattgaaaacggatctgacaggcaaataccgcatcaataataaaatgcgctgtaaccggaacgaataaattgccggtccattcatagataagccccagcaaaagactgatgcccgcaaccatcataaacagaagccacttcgccaagtatctgaaatgaagcacggtaaaaatgaagctggcggcccataagccgatatgtgtctgcagaacgcctctgaacaaaatctcttcgctgaacgaaatgagaagcgtcaaaaacaaaatgtgcagaaccggcctgttcttaaaaagcaatacattaatgccgccgtcatcatataaatgcgaaggacaccatttcatcaccgccagatcggcaaaaatgacaaggacggcaagagttacaccgtaccatatgatattatcgtcacgtatatgccacagctttaaaaaatcgtgaatgtcggtgaaaaagaaaaagccgataacagctgaaaccgccaatatgagcaattgggtggcatacagctgtatcacaatctcccggtctgagagctgctggatcaattcgctttgccgtctcagctgaactcacccgcagactctgaaccgaaaatccggcctaattccagcttccaatcttcaaaccgttccatgtttttccgttctcctttttgctcgtacggagccagatcaagtccgcagctgctgcagcattgtccggtttggccttcaggctcatacgattcatcaaaataagacagcagcgcttttcttatacattctttccgctctaataacgccgaaaaacggttcattttacgcagcttcttttccacgcggtatgtcagttcttcctgcagctgctcttttgtggtttttccttgcagatacagatggacggccgttcgcgcctgtgtttcctggacgcctttattgatcagaacgtcccgaagctttcgctcatcatccgtaccggcatcccgtatgacggccaaaatgccttccagatcataatcagacaggctttctgtctgaataatctgctgctgaagctcggtatcgccgggcgccctcagcaaaatactgacactcgggctgccgtcgcgtcccgctctgccgatttcctgcataaagccctcagccgtttggggaggataaaagtgaatgacaaagcggatatctgacttatccacacccatgccgaacgcattggtacagcagatgcaatcaagctggttatggataaattgctgctggatcaagattctgtcccctgtatccattccgccgtgataataatccgtccgctttcccgttttttcattcagctcagccgcaagctcttccgcccattttctggtcggacaatatatgataccggggccttcaagcttttcggcaagctccgtgagcctgtttattttttcggcattatcagccaaatgttctgccgccaggagaatattcggccggttgactgaataaagatgacgcaccgcatgctcaagtccgagcacatccgtcacgtctctgagcgtttcttttgtcgctgttgcagtcagcgccaatacaggcggctttccgagtgcctgtctgaaaggcccgagcttcgaataatcaggcctgaaatcatgtccccattccgatatgcaatgagcctcatcaataacaaataaactgaccggaacgtttttcaaacggttcagtacataaggtgaagaaagggcttcaggagacatatagagaaatttataccggctgatgttgctgagaataaaatgccgctctgcggaattcagcatgctgtttaatgccgcaacccgcttttctccttttgctttcagctgctgcacctgatcttccattaatgaaagaagcggtgaaataatcagcaccagcccgtccatcatgtaacccgggagctgatagcataatgatttcccccgccggtcggaagcatggcgatcgtatcctttttttggagcacgctagtcataatctcttcctgcccttttttaaaggaatgcaaaccaaaatatctggataaagctttatgcagctcagtcatgctgattcaccgtctttgccagcgccagcctgatctggaaatagctgaagcgcatctgcattccttcgcgaatccgtttaattttatttgtttgatgctgttttgcaaatgccgttatcatacgctgttcctcttcagaaagatactgttctataaaaaatgcaggctgatgcaatgatatttctacgatatgatcttcgattgtggcggtttttaaatttctgaccgcggcgatccgttcaatcggaaaccctttttccaacagctcaaaggtttttctggcagactgtgtcagcgcgctttccgcctgcagatcggacaacagctcgcgcagagcgggatatgcacattgcggaagcgattgaataacataatgtaccgctccccaaaactggacggacacataccattcatcttcgttcagctggagagcgagctgcttattcgttttgccgattctgttgaatgaagttaaagaatagacaaaaataagcgcctgccgttcacttacgccttgcagaagctgaaacagcgcgtcatgcatttggacggaaagctctttagcatctctgtttttccgcatgaaccatttgacccatctcagcgtctgcacatcgttggtaaccgggatatattgactgcattgatgctctttgtttgacaggacttgaatgagcagggaaagccgcctccacaggatgacggcaggcgtttgataatttgcgccgtggcagtgcttcggccaaggccgctcagcaaacgcccgttcaagcctttgaacgccgcgcgcagtcactttccgcgttccctcttcttttccggctgtgatgtatgagttctcggtgagtctatgcatagaagccgcaatatcgccgcgttcacactgtgaagccatgccgaaatatttagcgatctgaaataagccggcatcctgaatggtttgagacgacttttttccttttaataaatgaaacacagcactcggagtccgttcgccgtctattttgtccagacagtcgagaaccacggtatcaaagtagtttatcgccaatctaaacacacctacatttcttttgtgacaagtttcgttttttggttctttttattttaacagattttcatataaatttgacgtttaaagtcatcttttagggggaagtgctaaagagaatcccttatgtgataagcattctcaatcatttttctgttgaaatttgacactaacatcattacaataagtaagaggaataggtgttatatttaaaaatatataaggtaaaccatttgttccaacacgaacaatctgggaggttttattcatggcaaagtacacaattgtagataaagatacgtgtattgcatgcggcgcctgcggagctgcggcaccagacatttatgattatgatgatgaaggcattgcgttcgttacgcttgacgaaaataaaggtgtcgtcgaagttccggaagttctggaagaagatatgattgacgcatttgaaggatgccctactgattcaatcaaagttgcggatgaaccgttcgaaggcgacccgctgaaatacgaataaaaaagccctccccgtgagaggagctttttcgtcctgaataagactccggctgttatcggccggagtcttatttttttgccgatcagcacaaacaaaaaaagcgtccggctgttcttcacagagcggacgctttaagcctttattgtgtttggatgctgcgtttttgttcaatccaaggtttcagcttcgtaaagatgaacgtaaagacgatggtgatgataatgccttttacaatgttaaacggcagaattcctgcgacaaccgccgttttcaactggctgtttgacaatgccggtgaatgtaaaaaccaagtatacgcgggcaggataagaatatagttcaaaatactcatcagcacggtcatcgccgcggttccggccagcaggctcactgcaagcccttttgcagaattgagctttttaaacataaacgccgtcggcagaataaacagcgtccccgcgataaaattggctgcctgcccgacaggcacgccggccatgcttccttgaatgatatactgcagaatatttttaatcgcttcaaccgcaatccccgccgcaggcccgtaaaccaaaatagcgataattgcaggaacgtcactgaaatcaattttcaagtaatccggcagccccggaaacgggaaatttaacagcataagcacaaacgcaatactgctaagcatactgatgacaactaatttttttactttcacaatgctctctccttttcgatcaaatctctcgaaaagaggaaaggttcttttgcgccccaataaaaaaaccgcttttgttaaaaagcgggagcttactaaggcttggcaaagaaacgtttgatataagcatcaaaacgtctgctgaacctccatcttctcccatccagactatactgtcggctccggaatctcaccggatcctgccgccgaagcagctcgcgggcttagagcgtgacgctcatcaccgccggtagggaatttcaccctgccccgaagattgatcttatgaatttattcacattatatatgatcaaattgtaattgtatagagaactgctcaaatttaaataaaatattggggaagcccaatttcagctgattcagcggtttccttttctcctttactgcgtcaatacacattgacactctattgagaatatgataaattatcagatatttagtcagctaaactaggaggaaatctaacaatgtttcgagttttggtctcagataagatgagcaatgacggcttaaagccgctgatggaatcagactttatagaaattgttcaaaaaaacgtcgcggatgcagaagatgaattacatacctttgatgccctgttagtccgcagtgccacaaaagtaaccgaagaattgtttaaaaagatgacttctttaaaaatcgtcggcagagccggtgtcggcgtagacaacatcgacattgatgaggccacaaaacatggagttatcgtgataaacgcgccgaatggaaacaccatttcaacggcagagcatacattcgcgatgatttcttcattaatgagacacatcccgcaagccaatatctcagtaaaatcaagagaatggaaccggacggcttttgtcggggcggagctctacggaaagactttaggcattgtcggtctgggccggatcggaagcgagattgcccagcgcgccagagcgttcggtatgacagttcatgtattcgatcctttcttaaccgaagagagagccggcaaaatcggcgtaaacagccggacattcgaagaagtgcttgaaagcgcggatatcattaccgtccacacgcctttaacaaaggaaacaaaaggattgcttaacagagaaaccattgccaaaacgaaaaaaggcgtccgtcttatcaactgcgcaagaggcggcattattgatgaagcggcgcttttggaagcgctggaaagcggccatgtcgcaggcgctgcccttgatgtgtttgaagtggaaccgccagttgaatcaaagcttcccgaccatccgctggtgatcgccacacctcacttaggcgcttcaacgaaagaagcacagctgaatgtcgcggcacaggtttctgaagaagtgctgcagtttgcaaaaggtctgcctgtcatgtcagcgatcaacctgcctgcgatgacgaaagatgaattcaaaaaaatccagccttatcaccaaattgccgataaaatcggaagtctcgtatcacaatgtatgaaggaacccgtcaaagatgttgcgattcaatatgaaggcaccatcgccaaacttgaaacatcatttattacaaaaagcctgctgtccggtttcttaaaaccgcgtgtagactcaacggtcaatgaagtaaacgcgggcggtgtagcaaaagaacgcggtatcagcttcagcgagaagatttcctccaatgaatcaggatatgataactgcatcagcgtaaaagtaaccggagaccggagcacatttacgttaacggctacgtatatccctcacttcggtgaacgaatcgttgaactgaacggctttaatattgacttaaatcctgccggccacctcgtttatatccagcaccaggatacgactggtgtaatcggacgcgtcggacgcatcctcggcgataacgatatcaatatcgctaccatgcaggtgggccgtaaagaaaaaggcggagaagccattatgatgctttcttttgataaacatttagatgataaagtcgtcaatgagctgacttcggttcaggatattgtttccgttaaactgattgaccttccgtaaccaacagaaaacccaaaacattcatatgttttgggtttttttacgtttaatgggtcggaagcggattaggcgcggcaggcacagcaatcggttttgtcacatcataattaccgattttctttgcgtgcgcatgtgtgaacagcacctcagaataaccgaattccttcgcggttaacaaaagcccttcgatcattaaaatgccttccagcgaatcttcaactttatgtttttcggacaattggatccgcagctgctcgccgtcttccctttccgataccgatgcaatcgcatctgcttctataatgctcgcggtctgtgagcctccgtctgttgtcttcatcccgtcaatagcctgatatactgaataataggtttgttcagacgggatgagatactcttgtcccagactgtcgctgtaagaaaaatacgcccggtttgtctgtttatgtacggacatctcagcggaaatgccgtaagatttataaaaatcctgtccgtctccgttttgaacctttttcaatttaatccgctcgtaaggactccatgtcaaagtctctttcagcatctttttcaataaatcagaatcggcagctgattcgatagaaagacgtccgtttacctgcacaagcaaatccttcttatccgccgttacctgcacaccgtccaaaaggttcggcacagagaggaaagattcgggcacttctaagtttcctgcatcagataatgcctctgaaaccgattcgtcaggcttctttttttcaaaactgaccggaatgacggcggatgtatctgaatcggcaaacgccaaagtaatgtaattgtttttgttttcgttagaaacgacaaacgtcttctgatccggcttgacagcagctgactgactggctttttcagcttgaccgctgtcagctgtaagatcaccggcagatttgtttgtcatcaggtgaggagaaataatcagagcgatgcacaatgcgcagatgccggctgcagcggggccgatccagcttcgggccggttttttcctgtacggtttacccgtttcaatattccggtaaatggcctcgggtgaacgatgatctctaaccgccggaagttgtcttaacaactcctctactctttcttcgttccaatatgacttcatcatccattagctcctccctcaaaagctccatctgtttccgaagtattttgagccctctgtgttgggtcgttttgactttgctttccgagaagcggagagcggcggctgtttcctgaatggaatatccctgaataaatctcaagataataacagctctttgatcaatggtgcaatgatcaagcgcggtataaatttcccggacattttcatgctgtacggcgagttcgtccggaagcaaatgctgatctctgacatcttgtgtatcccaatcaaacgtacccataatacgctgtctgatcgtctgctgcttgcggaaccagtcaatcgccacatggcgtgcgatggacaacagccatgttttttcactgcttcttccttcaaatgtatgataggaattcaagacgcggatatacacttcctgcgtcaaatcttcagcctgcgacttatcttttaccatataaaataaaaattgatataaatcttgatggtatgcatcgtataatatctgaaaggtttcttccatgggaaacccctccgttcacttttttgtcgtaaaaatgcgttgaaaagttacattacaactatattacgagaaactggaatttggaagggaatttatattaacatattcttaaatttttaaaggagaaaaaaacaaaaaacacccgcatgttctgcgggtgtttcgtatggaacaagattgttcgtcaatttcagacgtcatcctgcgcttttgtcggaatataaaatgtaaacgtcgtccctttgtcgatgctgctgtgaaccgcaattgagccgccgtgggcttccacgatattttttacgatggcgagtccgagtccggtccctgccctgcctcttgttcttgctttgtccgctttataaaaacgttcaaaaataaaaggcaggtcctcttccggtattcccgagccggaatctttgatatcgattttcagtccgtcttttacggtatgagccgcgatatgaacgtttccgcctgactccgtatggcgcagcgcattatctataaggttggtaaacacctgttccattttgtcttcgtcaaagacacactccggctgagacaccgagatgtcctctgtgagcgaaacgcctttttccttcgctacaccggaaaatttgcgggagatcttctccagaaattcatgcaggtttaccgtttcatagcgcagacccgtatgtccggattccattctggccaaatccagtaaatcattgacgagccggcccatacgaagagattcatcataaatgatctgcgcgatttcttttttctcctcttcggtgcttgcaatgtcgtccactatcgcttcactgtatccttgcagcatagaaatcggggttctgagctcatgactgacattggcaatgaagtcttcacgcaatttatccagcctgcgctcttcggtcatatcacggagcacggccacggcgccgcggacgtgtgattccgcataaagaggcgacatcaataaaacccatgaccttccttgaagcgtcatttcaatcatttgctctttttccgtgttcactgcattttgaaacagctcttttgcttcagggggaaggttgtctccttctttaatgttcatgttctgctcataataccatgcctgcagaaaacgttcggccggcgggttggtcaccaaaatggtgccgtcgatattaatggtgatgaccccgtctgccatactgcttaaaatattggacagctgttctttttcctgattcagcgcgttaatatggaaattgagctgccgtcccatctgattaaaggcaatggccagttccccgatttcatcttgggtcagaatcggaatttttgtatcaaactttcctttcgccaagtcttgggcgccttcccgcattttccgaaggggatatgtcaccctgctggataaaaagaatgcgaaaaacgttgtcaagacgatggcaatgcccgccgcaagaaaaatatagcgtgtcgtatgtttcgtcgtatctttgacggcaagcagcgattgggataaaaagaccatgccttttttgccgtctttttcatagggcactccgacgatcagccgttcattatccgaaccggcatttttggggaccgcgcgtttgcttactttattgcggtctgtcagcgccttgtgcagatcccggtcatgtttaatctgctctaatgtaatagaggataaatgattatcgtcattgggcgaataccagacatgcttatcatcctgaatgatcgcgatgctcgttaaattgtccgccagttcccacgtgatggatctggcaagcggctggtcttcatgattttctattatgaccgcaattttatcggcaagctgcgttaaatctttttccgcttcttcaacgtggtaattttctataaattccagaagcagcaccgttaaaataaataaaacaattaacacgagtgaaagaatggtaaaccaaagctttcctactacgcttttccaaaacttcattcagcgcctacctcaaatttgtatccgactccccagacggtgacgatttttttcgccgctcccggagacactttgtttaatttttcacggagccgtttgacatgagtgtccaccgttctgaggtctccgaaaaattcatactgccacacttcttttaaaagcttttccctgtcgtacactttgtccggtgttttcgccaggaagtacagcagttcatattccttcggcgtcaggctcacctccgtgccgtccgcagtcaccctgtgagcatcatgatcaatggatagatgcgagaagacgagtacattttttgtcggggtattggctgtcagataagatgtttgggaagcccttcttaaaagcgcctttacccgaagcaccacttctctcgggctgaaaggcttgacgatataatcgtccgtacccgcttcaaacccttggacgcggttggcttcttccccttttgccgtcagcatgataatcggggtcgcttttttttctctgagctgccggcatacttctattccgtccgttcccggcatcattaaatccaagagcaccagatcataatctgatgccagccccattttaatggcctcgtctccgttttccgcttcttcaatcacatagttttcccgttcaaggtacattcttaaaaggcgtcgaattctggcttcatcatctactactaatattttagtttcatttgtttgatccatcgttttccccctgctttccttctgttactttcattttaacaaactgtgcggcagcttgagaactgtatcggctttttgcatctatgcgtacgaatgaagtccggcaagcacgagattcacaaaaattaagttaaacataataatggcgaagccgatgacggcaagccacgcggacttttcgccatgccagcctcttgacagccgcaagtgcaaatacgctgcgtaaaataaaaaggtgatcagcgcccatacttccttcgggtcccagccccaaaaacgcgtccatgcaagctgcgcccaaatcatcgcaaacacaagcgcgccgagtgtgaataccggaaaaccgatggaaacagcgcggtagccgacttcatcgaccaagtccagattcacatttttgacgagcgggcttataagagcgctgattctctttctgaatatcagcctgagcgccccgaataaaacgagacctgcgccaaacgaccagatcaccgtattgacctttctgcctgaaaaaatggccggaagctcaataagcggcttcattgcgccttccgtaagcagttctccgtcatgcgggccgacaagcgcaggcatatcatatatcatcacgcttttagcctcttttttatccacccaattaaattctgctttgtagtccgccagccggaatgccgacgtgacggcgataaatgccacggtcgtcacgagtataaacatgatgacttcaagccagaacgtttttttgcccggtctggattggtcgacatgctttaacaggaaaatgacgccggctacaaaactgatcgcaagaatcgcctgcccgagcgccgcagtcgtgacgtgaatgtacagccaattgctctgcagtgacggaataagcggcgtgatgtctgtcggaaacatgcttgcatatgcgataagcaaaagcgcgatagacaatgtgaacatgcctaatgaaggcagtctgtaaataaagtaaataataataaaagcgagaacaagcatcatgccgaatgacgtcgtaaattcaaacatattgctgacaggcgcatgtccgcttgccgaccatctcgcaataaagtagccgaggtgacaaagaaatccgaaaatggttaacgtgattccgatagccgaccagcggcccttaccgtccttcgcaccttttgttccccggatggcgccgccgaaaaccgggacggcaattaaataaatcaaaaaggcagcataaagaaaatttgcgctcagctccgccatgacaccactcctttttcactaggcctgatttttggccaattctttttgatcggccggctcttgaatcccggtcccgctaagaacaaattcgatatcctttttcagaccgaaccagtttttgttcgtatgtcccgccacaagcacttcatgatcacctgttttgatccagatccttctgtgctgccagtacatcccttgaatgacgccgatcataaagatcgcgccgccgacggcaagcacccataaggttaagtcttttctgacggtgagtcctgtaatgtttttcgtttccacatggtcgaattttaatttgtacttgttactttcggaaccttcaacagtctgctgaatcgcaacaaaacttttctcccctttcggcttgtcgggagccgtgattttaaagacaaaagccggattgttaggaaccttcgtcttcgtgctcggttctccgtctttgttaaaataaaaatcaggaagataactggcaatctgcactttgtaaccgttaccaagatcgtagtccgtgtcgggatcaagaagattgatcttcagtttgccgaatgactgttttgttttttggtcgatcagctgaaataccatctgatcgagctggttttctttatagtccacctgatacacagaataggagtcaaagcgcagcggttcattgacgcggatattgttttctttgactcttttaagcttcggcttttcaccgaatacaatgtcgccttccctcttgtacagaaccgcgtccgttgtgaaggatttggcgactttgccgtttccggctctgtcaatggcgtcggcgaatacttttttctcagtgtctttgttatatgtctgcatcgtgaaccggttgttttttaagtaatatttgccgtctgtaccggggatctgggcggtttcgccttcacggacccagagcgtttcatcgacatacataccgggtacaaatctcagcatggctccgatcagaaaaatgatcaggccgatatgattgacatagggtccccaccttgaaaaacggcctttttccgccaggatgcttccctcttgttctcgcactctataatgcttttttttcaatcgtgttctgaggctatcagccgcatccccgctcagctcggtttctgtccggctgtatagacgctgcctcttcaaaaagaccggattccgccgaactccttgatttttaagcgccctgtacaaaggaatcacccgatccaggctgcagatgaccagtgatatgccaatggatgcgatcaggagcatataccaccatgagccgtacaggtgatgaaaccccagcaaataatacagttggccgattatgccgtactgctgttcataatatgtatccggctgggcgcccggaggcagataagcttcctgcggaaaaaccgtgccgaaagcagacgccgccagagtaatgacgatcagccatattccgacttttacggaagaaaagaagttccataccttatctacgattgttttgttatatgtttgcgaacgccttgcgctgccgtcgtaccgcatatcggcaagcggcgatttttgatcatcaagcggcttcccgcacgactcgcacaaaaccgtcccggctggattcacgtgcccgcactcacatttgacctttttcatgaagacgcctccggcttaattaaattcatatagtcatgaaccatgcgttctgtcatcgtgccggtcaccactttcacgacctttccgtcgggattgatcaaaaatgtcgtcggaataggtgatacgccgtacgcgtccagcacttgccggtcagtatcgagcgcaaccgggaaattgacgccgtatgttttcataaaattatgtactgcaatttttgattcgccgacatttaccgcaaccacctcgacaccgaggtctttaaaatgcttgtattgattctccatgtagggaaattcctgcttgcacggctcacaccacgttccccagaaattcagaaaaacacctttcccttttaactgactcagttctatgagtctgccctctgtatctttcagcgcgaaattcggggctttggacccctcagatatacgctctccgtttgtgtaaacggcattatagatggtatatccgagcgcgcagagtaagatgagaaggatgccggtccgaatgaataaacgccgccgttttttgttcattgtacactgctcccctcccctgtctgcaaatccattcaattatatcatctacacgttttgtaatttttgaaggttatgtgaaaattagaaagcgtttttaccgtgttcagctaaagcccgcagccttttcacctcatgcggcgtcaattctcttgcgtctcctgtgcgcaggcctcttaaatctaaaaatgcgtattcttcacgtttgagtttcagcacgtcatgaccgatcgcctcaaacatgcggcggacctgtctgtttcggccttcatgaatcgtcagctgaataatgctcgtctgctttcttttgtccagggaaagcattttcgctctggccggcgccgtcttgccttcttcaagctgaatgccgcgctcaagctttctcagaagttccttggaaggaatccccttcactttggcgacgtacgtcttatcaatttcgtatttcggatgcatgagtttgttggcaaactcgccgtcatttgtcagcaataaaagtccgctcgtatcataatcaagcctgccgatcggataaatgcgctgcggcacttctttgaaaaagtcggtcaccactttccgccctttgtcgtcatcagctgctgagatcactcctctcggtttataaagcagaaagtacacgggttcttcccgctccacctttaatccgtttacttcaatctgatcagaaccggtcacttttacgccgagctctgttattacttttccattcacctttacttttccttcttttatcagctcttccgcctttctgcgtgatgccacgccggcatgagcaataactttttgcagtctttccatgtcgttcacctcaagtataatcttacttttttccccttgaacaaacaagctttttcaaggagagttattctgatatataaaaagcgcctgatttcaggcgcttccaaataataacgcaactatgatgattgatgcaaccaccccgatcagatcagcaagaagaccgacctttaaagcatcccccatttttttgatgccgaccgccccgaaatacaccgtcaggacatacagcgtcgtatcagtcgatccctgcatgaccgaggccagtctgccgataaatgaatcaggcccgtacacggcgatcagatctgtcgtcatgccgagcgccgccgtccccgaaatcgggcggatcagagcaagcggcacgacttctgcgggaatgccgagcgctgtaaagaaaggcttgcacagccccatgacaaaatccagcgcgcctgaggcccggaatacggtaatcgccaccagcatcccgaccaaatacggaatgatggaaaacgcaatctcaattccttcttttccgccttcaacgaatgattcatacgtcggcacttttttgatcgtgccgtatatcaatataccggcgataataatcggaatcatggctaaagacagccaattcaccatttccattcgcttacctcccttttcttttgcggcggtaccagaagtagcggtcaatgaaaatcgcgccgattcccgaaattaaagtcgctaagatggtcggcccgacgatatcggtcggtgatttcgccgaataagccatgcgcacggcaatgacggttgtcggtatcaatgtaatactcgaagtatttaccgccaaaaaggtaatcatggaacggctggcctcagacttacctccattcagctttttcatctgctccatggctttaatgccgagcggtgtcgccgcatttcccagtccgaaaaagtttgccatgagatttgataagatgtaccccatggccggatgatcagggggaatatcgggaaacagcttagagataaacgggcggcacattctgctgaatatatccaaaaggccggactgctcggctattttcatcaggccgagccagaagacgagcacgctcattaatccgaacgagatcgtaaccgcttcttttgctcctttaaaaacagcttcattcacatcctgcaaggtaccgttaaacatcgcaaagacaagtccgattaccgtcagacatacccagattaaattgaccatgacgaaccgcccgccgcgctcataaacaggctcgtaaacgtctcaatgaaatgctttttcggttttttatggcgctcgttttcataatagacgggaatcttggcgatcactttcccatcatgcataacagtcatccggccgacgacatcaggaatgagagaggcgtcctttttccaggcttttttcggttttattaaggttgtgcggatttttacatcgtcgatttcatcctcttttaataaatatttgacatcccgggcaataaaagcgtgttttccgtaaaacgtctttttcagcttcggaatgccgccttttttagcgacgacataggttttatagtgttcaaagacataattaaacatattcatatggtcatcccagtcatccggatcatttatggtgaccgcgatgagatccgttccgtcttttgaagccgtcgaaacgagcgtccgtttcgcgatttttgtgtaacccgtttttccgcctgtgctgtaacggtagagcccagtcagaagcttgtttttatttttccatacccggtccatcgtttccgccttatacacttttgtgcctgaaacggtccggtattccttgattttcattgcgtatttagtcaaaagcgccatgtcatacgccgttgaatataaattttcatggtcgtccagtccgtgcggattttgaaattttgtattttccatcccgatttgctcggcttttttgttcatcataaatacaaaaccgtcaaggcttccgccgacatattcagctattgccgcagcggcgtcatttcctgatctcagcataagcccgtatacaagatctttcagctttactttttgtcccggctgaagataaatggctgagccttccgtttttacagcattcggggaaaccgtcacggtctcttccatctttcctgattcaatcgccagcaccgccgtcatgattttcgtaatgcttgcaatccgccgcttatgatgttcatccttggcgaataacaccctgccagatgctccgtcgataataatcgcgctttttgcgctgacatgtatttgggcatgtgccgtattgccgtctgtaatggaaaaaagaataacaaaagtcaaaagaaatacggcagcttttttgagaaagcgcatgaatgctcacgtccttgttgtgggtttgtacaagtttatgcgcctgtccatgacttatgaataccaattgcatcactttcacataaaaaaactctcccaaaaggaagagtttttatctgactgatgccatatttgagcctgatgcttcatattgcgccaattcttcccgcatccgcagaaattcactgctgagcgaaagcagaaggctccgcagcgagtccggcacttgctggtagaactcaatcgcgctttggcctgtataagcggcgcggctgttttcgtaccatgtatccttttttggcatgaaaaattcttccacgcactgatgatacactttatacagcgttttttccgctctcacctcatgaaacggctcctgcattaagagccgccggcaggcttcctgggcgccttcgcaaaagacggtcatcctcctcagcacactgagcacgtcgcggcagtatgcctcatccgcctctccttgagcccgcatctccggcaatgttgtatgatttaaatagctgctgaccatcgtgacaacctcggctaaaaattcaccagtttcttcagtatgggccctcacaatcgaatttcccatttccgtccgtttccttcctctcttgtacgtcgtcatttgcgtcattcatcaatggcctttccctactatcgtatgatgaaaaacgattattatttaatatcctcaaaagtttggttgaagttttcaaagaataaatcggcttcctcctggagaacgtcttcctccgcattttcaggaagcggcgggagctcctccaatgtttttaagccgaattgttcaagaaataccggtgtcgtgccgtataaaatcgcccggccgggaccgtcggcgcggcccacctcacacagcagcgcttttgacacgaggctgtgcagaatccgctcagacttcacgccccggatatcttcaatttccgcccgtgtgatcggctgcttgtacgaaacgatcgccagcacttccaaagaagcctgcgacagcccttttgacggcacttcgattagttttttcaaataaggcacgaattcttttttcgttccaagcatatacgtatccgcatattcggtaagctcgatgcctctgtcgtcttccttgtactgagcggccacttcttccatgattccggccagttccgcttcttctatttcaagcaccgtcaccaattgctttttggtcagtccttcatcacccgccgcatacagcagggcttccacaatcgctttccaattcacgatatcaaacgccatgaatggattcactccccgtaatgtatatatctgaaaagttttcttcctgttcaatgataatctgctgatttttcatcagttccaggactgctaaaaacgtcacgacgagatggtccctttgccgagaaggaaaaagctccgtgaagtttattcttctccccgccgtttttaagctttttacgatttctttcattctgtcttcaatcggtatttcctgtcttgtaatggtcgtttctttcggccgcgtgatttttttacgctgaagcaccttttgaaacgcgccgatcatgtcataaacggtcaccgacagtttctgctcggtctgtttgatttcttttgcatactcacttaaatcactcggcggctttgtaaatgacttttgtctttcttcttcccgctcttttaaatccttcgcagcggttttatactttctatactcaatcagcttttcaatcagctcgtcccgagggtcttcttcttcaagcatttcgtcttcaaacagctcttcttcttgtttcggaagcagcattctgcttttaatgctgagaagcgtcgccgccatgaccagatattcactggcgacatcaagttcaagctcttgcattgtatgtacatataataaatattgttcagtaatggttgccacgggtatgtcatatatgtcgatttcaagacggttaatcagatgaagcagcaggtccaatgggccttcaaacgtatcaattttcacttgatattctaccattatctcaccattttcagtatcactctcattgccggaaaaactggctaccctttagtataatccaccgaaatgctctcgtccaatacttttatacacgtcctccgttatttagaaaatactgaaaaagaagatatacgcctatacctttaaaggcggatgcacataggatagccgtgtaaacttgaaacaaagggaggctgatttcacatgagcggagcttgtttcggcggaggttttgcattaattgtcgttctgtttattttgctcgttgtcgtaggagcatcttacatctgctagttcctcaggcttcagacaccaagccgctcttttttccttttcaaagcgctgtggtacactggttttagcataaaaggaggaagcggcttgtatcctaaagcttatatcggctttttggccgaatttcacgcatcaagagattattttgaatgtcatgaactgttagaggaatattggaaagaaagcccggctgaaaagcggagcattcattgggtcggcctgattcagcttgccgtcgctctgtatcaccagcgcaggggaaatgaagccggggcgaaacggctgattgccaacagcttacgtattctccggtctgaaaagcaggcggtctgttctctcggtctcagccatccgaagctgattgagctgatagaaacgctgtcagacgatatagaagcgggcctgccttacagaagtgttatgcttccgattacagatgaagccctgaaagaagcatgtcttgccgaatgccgccgaaagggctatacatgggggcaagacggcgtatcagatacctttcttattcataaacaccgcctgcgggacaggacggatgtcattaaggaacgcgaacgggaaattgagagaagaaaaaaaagcagaggctgacggtcagccctgctttttctatatcaaaacagctcccgaaaccgtgaagattccgggagcatttgtcagttattatatgagatatcctgatctttttgatgttgacagcgttcaaaaaagctttgcgttaattcattcggaacgagtgcctccgttttgaacagacgttttaaggcgtccatcatttgctttccgattccttgatggcggtgagaaggattcacgctgatatgccggatttcaacctctgagtcctttttttcgactccgatcgctccgacgatatcttcatcctctttccaaagaaagagctggcggccagtatccgtttcatagtcctttattgtctgctgaagctgcttgagatctttttcattcggcataaatgacagaagacccatcgcaatcttttcaaacgattttttataacgaattaacataaaaacccctctatatccaaaatgtccattcatgtcctatcaaacggatacataaaggcgatccgttttctcacattatatcattttcgccgcggttttaaacgcttttcaacaaattattcaaatgaacggtttaaatttgccatttcaatggcagatactgcgcaatccgctcccttatttccggcttttgttccggctcgttcgatggcctgctcaatggtttcagtcgtcacgatgccgaagataaccgggacgcccgtcgccgttcccgcctgggcgatgccttttgccgcttcattgcagacatagtcataatgcgttgtcgctcctctgataaccgtgccgagcgtaatgacggcatcgtattttttcgtttccgccattttctttgccgcaaacgggatttcaaacgctcccggcacccaagcgacgtcaatgtcgtttgattctacaccgtggcgaagcagcgtgtcttccgctccgcttaacagcttgctcgttataaattcattaaatctgccgacgacgattccgattttaagtcctgttcctactaggtttccttgtatgatattcatatgttatccatccttttttgtgagatttgtttttagaaatgaagcagatgtccaagttttttcattttggtctgtaaatactgcttgttatgctcactcgcttccatttgaagcggcacccgttccgaaatgctgagaccgtatccttcgaggccggcgattttccgggggttattggttaaaagtttcatatgctgaacccctaagtcgcggagaatctgggcgccgatgccgtagttgcgcagatcaggcagaaagccgagcgcttcgttcgcttcaaccgtgtcgtacccttgttcctgcaatcggtacgccttcagcttattgattaaaccgattcctctgccttcctggcgcaaatacaatagaacgccgcggccttcttcagcaatttgcgcaagcgcggcatgaagctgaggtccgcaatcacagcgatgggatgcaaacacatcgcccgtcaggcattctgagtgcactctgacaagaacgggttcgctgttaaacgggacatcccccatgacaaaggcgagatgttcttttccgtcaacctcgtttgtatatccgtaaactctaaacgtgccgaagtcagtcggcagcgtaatatcaacttctctgttcacaagtgtcgtaatgttgtaacggtactctattaagtcttttatcgtaatcattttcagctggtgacgttcggcgatttcggctaactccggcactctggccattgtgccgtcttcattcataatttcacaaatgacgcccgctccctgagatccgcaggcttttgcaaggtcaacggctgcttccgtatggcccgcccgcttcaggacgcctcctttttttgcgattaaggggaaaatgtggcccggacgctgaaaatcgtcagacacagattcctcgttcaacagcgcctgaatggtaaaagaacgttcttgagcgctgatgcccgtttttgtcagcctgtggtcaatactgaccgtaaaggcggtctcatgtgagtccgtattatgatcgaccatcgggtgaagatccagccggccggcgatgtcttcagacagcggcgtgcagatcagacctctcccatgggtcgccataaaattcaccacttcaggcgtggcatgctcagccagcgctacgaaatctccttcgttttctctgtcttcatcatcgacaacaatgatgacttcaccttttttcagcgcctctaacgcctcttctatcggatgaaacatatcgatcttcctttctaaaagccgttctcgcttaaaaaggcttccgtgatagtttgattgcttttcgtttgttctgttttgtgcaaaaagcggtataagtatttgccgatcatgtcacactcaatatttacggtcgatccgactgttttcgtctgaaaaatcgtttctgagatggtatgcggaatgatggataccgtcacgctttcatctgatagaccgaaaatcgtcaggctcacgccgtctaccgtaattgaacctttcaatacgagcgtttttgtcaattccggcgaaagttttaaatcgtaatagaccgcgttgctttttttctcgatccgcgtaatttccgccgttccgtccacatgccctgatacaaagtggccgccgaaccgtccgttggcggacatcgctctttccaggtttactttactgccttttgacaagccgttcagcgaagtggatttcactgtttccggcatgacatcaaccgtaaattgattgtcagaaaatccggttacggtcaggcagatgccgtttaccgcaatgctgtcgccaagtttcacatcacttgtcacttttgaagcggcgatggttaatgccatggaaaggcctgtcttttcgattgcttggatcgtgcctgtttcttcaacgattcctgtaaacatcgtcaccatcctttccatctttaggtatggccgtcagttttatatccggcccgatttgggtgatttgtgtgaattgcaaatgggggacatctttcattgattgaaaaccttcaccggagatcaagctgggagcaagcgttcctccgattaatttaggggcgaaatagaaatgaagctcttggaaacagccttccttcacaaaacttccgtgtacggatgctccgccttccacataaacggacattattccgttttcagcgagaacactgagcacctcagggatgtgaatgcggtctgtttccagcggaaaaacttttattccgagtgcggtcagccggtctttcttttgcacgtctgcacctttggccgtaaatatccatgtcggcgcagcgccgtcagtgagcacatttgccgtttcaggaatggtcagctttgtatcgagaatcactctgaccggctgcttcaccgcatcaggaagcctgcaggtcaggctcggattatcggctttgactgtgcctgctccgacaagaatgctttgatgcgatttcctgtattgctgggcatcaagccttgccgcctctgatgtaatccatttgctgtcaccggtttcggtcgctgttttcccgtcaaggctcgcggccgctttcaaggtgacatacggaagtccggtccgcatgaagtgaagaaacattttattcagctcttctgcctgctgcctgagaaggccggttttcacttcgatgcccgctgcttccagcattccgatgccttttccggctacaagcggattcggatctttcacagcaatgaacaccctttttatccccgactttattatcagttcggcgcatggcggtgtttttccgtaatggctgcaaggctccagcgtcacatacaaatcggcgccttttgcgtgtctgccggccatattaatcgcgtgaacctcggcatgcgcttctccgtattgcaaatgggcgcccattccgacgatctgtccgtttttgacgacgacagcgccgacaagaggattggactgtgtctgtccttcaccgcgtctggcaagttctattgccgtattcatataatattcatccattgttatccctcccttcttccacgcaatttggcgtcaaaaaagccccgaatgtttacacagttcggggctttgccagttttaatccataggaaataagactatacagtaagtttattttttgcatagcttctctcatccttctcccatccagactttcactgtcggcttcagcttttcactgaatccaccgtatacagatgcatacgggtcacgggctgtaaagcgcaaagcgccttattaccgccggtcgggattttcacccagccccgaaggatacaatcaatatttttttgtccttatccgctattataacatcctttgcggcaggcgcaatgaatttgcacctcattattcagaaaaataaaaagcgcccttttcccataaaaggcgtctttatttattcgttcactttgacgaccttcaataagccgtcaatccggtttgatttgctgaaatacgctttaatcttatcacctttttgcacatcggagagatcctgcttcagcttgtcgccgttaaaaataatttttgtgccgttcgctgccgtaccgtggtactcagttccttcgattttcgtaattttatatgttttgactgtatattcttctttttcctgggacagggtttgtccgattgcagtcggcacgtctttcagttcaatatcgtttatgaccatataaccgcccgctaataacagcagcagtacaagtaaaatggctgcttttgttttaattcttcccatttttctacctccagcccgtatcaatctattcattactatgtcatattcctttttttcatgaatagaaaaccgttcttccctgcgtgagttattcatataacgtttcataaagggaagatgtttcatgtatctgtaaaactttctatctattaaatagatatacgaatttatgttctgtttttgagggtggagagataaatttatataaaaaaagcagttttctcatgaagaaaactgcctgtacggtttatttcgtcttgcgaatttcgttaaacgggaagaagacgaattttgatgtgcccgctatttgtttttttgtaaaaagaccgaggccgttgcggctgtccatagattctctgcggttatcacccatgacgaaatatttgtcgtccggcactttcaccgggccgaagtcttctgtcagccggtcatagccgtcttgcttcgccttgtgcttatttgccgctaaatacggttcggacacttttttgccgttgatatacagctgatcgtttttcatttgcaccgtgtcgccgggaagtccgataatccgtttgacatagtgctcattttctccgttcagcacgacgatctggtcgcgtttgaagtcgcttatgtatttgaccgtcatattgacaaagattctctcgcggtcatgcagcgtcggatccattgatctaccatcaacgagataaggggcaaataaaaagtttcggatgagcagtgccagaacgacagcgatgataatggctttcgcccaatcaagtacggcgctttttttagaagttttttctttttctgatttcaagtgatttcctcccattagccatggtcatttttattttaccatgaatccctgcacagagggcaaataagccccgcaccccatccctttttttcattttataagccggatctgctgattttacggtatttcacgaagcttccgatccgccaaatgcacaaatacacaaaagcaagctccatcgttaaaacggcgaattcagccgcgtcaatgcttttgaaatattggctgagtgcgatacggatcgcaataatcgcgataatgacatatttaaagtttttattccgcttggagtagacaaagccgtcttcccggatttcataggcggtttgcgacagcatgatgataccgaataccgcgcctaacagtccggcgatggcgagctcccaaagagcgggaaaatgaaacggctttcccgggatattcatgagctggctgatactgaatgtaaaaatgacggcgataatcaaaagcgggagaatgatgcctaagccgccgcctttaatcggcctgtttcccttttttaccctgaaccaaatcataagtgcgagaatgataatgacaaataaaacggttgccaattgaaccaacgtttctacctcttttcattgttgtaatcggtctttttcactataccagaatgatcaccgatgttcatatatgtattttttcatgatttacacatgagaattttcatatacataaaaaaaacccgcctgaaaaaggcgggttttccgtcattatccttctacacggatttctttcattttgtctccgttagacatgtttttcgcatgctctaaaccgcttgtcacttttccgaatacagtatgaacgccgtttaaatgcggctgcggctcatgtacgatgaagaattggcttgaacccgtgtctttaccggcatgcgccattgataaagaaccggcttcgtgtttatgcggattgccttctgtttcacatttgatcgtttttccgcttccgcccatgcctgtcccagtcggatctccgccttggctgacaaagcccggaatcacgcggtggaaaataacgccgtcataaaagcccgtattcgccagattttcaaagttagcgactgtattaggcgcttcattcggataaagttcaaattcgattctgctgccgttttccatttcgatgtaaccagttttcattctcattcctacttccgtattgttttttgtcaaagccttctttaatatgaatttcaattgtaagccggctttctttttgatattcttttgaaggaagaggcctctgctcttcttttcgcggctattataccacaccttcagccggaaaacgaatctccccgcttccgcagaaagaaaatgaaaccagaacagcttcacagccgtctatgtatcggaactgcttctcgcaggtcctcacaaaccgcttcaaaacggcatttgtgaaaagaaggaggttaaccgctttgaaaaaaatgtggattggattgctggcggcggccgttgtattgtgcacaataccgaaaatcagcctggccgatgccgcagtcggagatgtcatcgtcacactgggggcggatctgtcaaacgaaaaccgtcagaaagtgcttgacgaattaaatgtccctgataacgcgacaaaagtgacggtcacaaataaagaagaacatgaatatctgggaaaatatatatcgaatgcccaaatcggcacaagagccatctcttcgtcatccattacggtggcaaagaaagggtccgggcttgacgttaagacccataatatcgattccattacggatgaaatgtacttaaacgccctgatgacagcaggagtgaaagatgcgaaagtatacgtgacggcgccgtttgaggtatcaggcaccgcagcattaacgggaatcatcaaggcatatgaagtctcatcagacaaagcgatttcagaagatgtaaaacaggtcgccaaccaagagcttgtcaccacttcaaatctcggggataaaatcggggataaaaacgcctccgcgcttatcgcaaacattaaagatgatttcgcgaaaaacggtgtgcccgatacaaaagaaggaatcgagaaaaaggtcgatgatgcggcttcaaaccttaacattacactgactgacgctcaaaaagaccagctcgtttcattgtttaataaaatgaaaaatgcaaagattgattggggccaagtcggcagccagctcgataaggcaaaagacaaaatcacgaagttcattcaatccgatgaaggcaaaagctttgttcaaaaagttattgatttcttcgcttcgatttggaatgcgatcgtgtctgtatttacaggagacagcggatcaagttctgacagctgaacgcaaaaagagaccggacgccattgttccggtctcttttttatttattgtttgaccccagtcttaaacggcagatccagttttacaatgtcttcataagtttctcttctaatgacaagatgcgcttcgccgtcttccacaaaaacgacggcgggacgcggaatacggttgtagttgttagccatgctgtatccgtacgctcccgtgcagaaaacggcgagaagatcgccttctttcacttccggaaggtctatatcccaaatgagcatatccccgctttcacagcacttacccgcgatggataccgttttgtcgtggtgttctccgattctgtttgccgatacggcttcatatttcgcctgataaagcgcaggacggatattatcgctcatgcccccgtcaaccgctgcatatttacgggtgccgggcacttctttttgcgaaccgatggtataaagcgtcgttccggcatctccgacgagcgagcgtcccggttcaatccagatctccggaatgtcaaaagcgtgcagcgctgcgttttcttttaccgcttcgataattttttccacataaacggcgggatgaaggggttcatcctcttccgtgtagcggatgccgaagccgccccctaaattcagcacttcagagacaaagccgaatgattctctccattcattcagttttgcaaagattttttctgcggccagcacaaagcccgccgtatcaaaaatttgcgatccgatgtggcagtgaacgccgagaaggcggatatggtctgactgcaatacttgttcaatcgccttttctatttgcccgttatgcagatcaaaaccgaatttggaatcttcctgccccgttgtaatataatcatgcgtatgggcctctacccccggagtgatccggagaagcacatccattgtgcgccctgatttgcggcacagttccgcgagtaaggatatttcataaaaattatcaacgacgatgcagccgatttgatgatcgagcgccattttcaactcttctttgcttttgttgttgccgtgaaaatgaatcctgtcagccggaaaaccagccgcaaccgccgtaaacagctctccgccggatacaacgtccaatgagagcccctcctgctcagcgagctgtatcatcgcaacggaagaaaacgccttgctcgcgtacgcgacctgcgcctttaaatccgcgtcaatgaatgcctgtttaaagcttttagcgcgctcacgtattaaagccacatcgtaaacataaagaggcgtgccgtaatgctccgctaaatacagcgcgtccacacctccgatttccaaatgacctagtttgttttgtctgcttgtgccatgtaagaacaatgctcattccctctttctgatccgcctatgggtgaaaaggacagcttcttttgagctgtccttatacaagtcccgtataagttaagacatacaatatcataatcttctgtcggtttcaatgcgattatgaaccgcttggctgtctttgacggtctttcgggtgaacaatgctcggtctgactttcgctcccggcactgtcgtccggacgagcacctgccacagcgccttgccgttaaacggtaaaaacggccataaatacggcgtatgaaacgaacggatattcgccattatgatcagcagcaatgtaaagcctatcacaaagcctttcacttggaaaatggccacgagcaccattaagatgaggcgtatcattttattggcgaggctgagctcataactcggcgtggtaaatgatccgatggcggcgatcgatacatacagaatcacttctgctgaaaacagccccaccgctatggcgatttgaccgatcagcaccgccgcaatcagacccatggcggtggataaagcggtcggcgtatggatcgcggccatcctgagaaactcaatccccaaatcggctaaaaagatttgcagaatgatcgggatgtgcgtatttttatttaaaccgataaaatccaatctttcaggcagaagagacggttcgagaacaaagagaaaccagatcggaagcagaaccgttgaagcgataataccgaagaacctgatccatcttaaaaatgttcccactgaaggcgcctgcctgtattcttccgcatgctgaacatggtgaaaaatcgttgtcggcgttatgatcacgctcggtgacgtatcaacgacgatgatgacgtgcccttccaaaatgtgattggcggccacatccggccgctccgtgtatctgaccatcggaaacgggttgtagccctgtttgacgatgaattcttccactgttttatcagacatcgtcaatccgtcaatgtcaatcgcattcacttcgttttcgacgatgctgacaaggtccgggtccgcgatgtcttctatatacacaatggcaagatcggtcttagagcgctcgccgactttcgtaattttgacgcggagcctttcgtctctgattcgtcttctgatcaatgctgtattaatgacgatattttcgataaaaccgtctcttgccccgcggacgaccttttccgtatccggttcttccggtgtgcgtccggggtaacttctgacgtcaacgataaaggcgaagcccgcgtcttcaacgataacggccacaagtccggaaagcacttgatctgttgcttcgtcgagcgttttgactttttggacctgctgattgacaagcctgttttcaacaacgtcaatcgcttcatccgcattctcatcataattattgacgtcgacgagctgttccattaaatgaatgataaacaaagtatcggttaatccgttgacaaagtaaatctggacttcccggtctaatactcgaactttgcggacgccgacatcatagctcgttcccataccgacgcggtctttaaaaaattgttcattttttctaggatcccggtataccttgatcatgttttccggtttttccggcatgactttcgctcctttctaaaatgaattcgaccgccttcatcgtaatcggcgagcctttggatatgtcatcttttctccccatctttcctatgtcgccgatgcccacaatgagaggaacgtccaatttatccagacaatacaccgtatctccgttcattctgtgctcgtccatttctctcattccggttttatcgacgccatactccgtcacttctccatcacggtcaatggagacatcgactttcgtccattcagcctgatgggtcttagaagcgaccgcaatcacccccagcacttcaatgtcctgatgtgaggcgacatatttcagcgccgtttcgcccggcccttccccttgcaggcctgaatcgtcaaacatgacaaacaccgggtcattcggcgcggctttaatcagctgaacaagttcggggccgcttctggttgacggattgccctttgattgggaaatacaccgcccgcctgctttttccgcggcatattcaattgttttggcggcgtatacgtccccgtctgtcacaagaatgaccttccgtttcgtcatcaggcattatcctttcggtttaaaaataatggctacaagaaatgcgaataaaatcgctgaagatataccggcggaagtaagttcaaaaatccccatggcgatcccgataaatccatgctcgtgagcttgatgcatggcgccgtgcaataagctgtgaccgaagctgacaatgggaaccgtcgcgcccgcacctgcaaattcgataaatttgtcatatattccgaacccatccaacaaggcgccgatgacgacaaaagttgtcatcacatgggcgggtgtcagtttaaaaatgtcaagcagcagctgaccgataatgcatatgattcccccgcaaacaaaagccaacagatattccatttatgatgcacctcccgcccgctcaaataccacaccgtgcgcgatggtcggaatggtttctttctgctggatcattgtcggacttaaaagcgctcctgtcgcgacaacgagcaccctgttcagagcccctgattttaattgattaaaaatatgtgtgtacgtaacaagcgcggagcaggcgcagccgcttccgcccgcaaacacctgctggtccggcgtatagatgagaagaccgcagtcatcgtgtttcgttccggcgggatagccttcttctttgagcaaatctttcacgatcggcgagccgacgcctgaaaggtctcccgttaaaatcagatcataatcatccgccgtgcggtttaagtcctgcaggtgctgtttgattgtgtcggcggcagcgggcgccatggcggatcccatatcgaacgggtccgtaatcccgaggtcgcttacttttcccactgttgcgcttgtaatcttgatatcagaagggttttggctgatgatgaccgccccgccccccgtgaccgttgaagtggcggtatccggtttttgcccgccatactccgtcggattgcggaattgccgttctgccgtcgcgttatggctgctcgtggctgcgatcgcccggttcgcaaaaccgccgtcaatgagcgcggatgcgacggcaatcgtttccattgatgtcgaacaggcgccgaacagacagaggaacggaattttcagatgtctggcgacgtagttggcggtcacattttgatttaaaagatccccgcgagtaacaaatcaatatcgctctttttcaaattctgtttttgcaaagctgagttgatggcatcttccattaactgacgttccgccatttcccagtttttctgattgcaatgcatttcatcgtatgtcttatcaaacagcgaaccgagcgggccgtctttttctttcggtccggctgccgtccccgccgcatttacaaataacgggttttcaaacacccaggtttgctttccggttaatttcattttttctcctcctacgaaaacagtttttcacaagcaaaccgtatcaggcctacgatataggctgccacgacgccgaatacaatgacgtttcccgccaatttaaacatgtttgtcgctactccgagcacgagtccttcacttctgtgttccagagccgcgcttgtcatactgtttgcaaaacccgtcaccggcacggctgaacccgctccggcaaactgcccgagtctgtcataaatgccgaatccggtcaaaagggcggaaattaaaataagagtggcggccgtcgggttgcccgctgttttttcattaaaattaaaaaagtggatgtaaaagtcttgaagagcctgtccgatcagacagatcaaaccgccgatcagaaaggctttgacgcaattccaaacatatggcggtttcggctgatagtctttcacttttgttttgtaattttcttttaagtttgtcacgtcggttcctccttatgaatgatggataaaatacagccaatgaaataaagagccggctattttgccgaacacaatggccatcagcaatataatgattttgctgccgaagccgatccgtttggcaagaatgggaagcacattcagcacttctgtaagcgcggcggccagcatgccgataaacatgccggccaaaagcccgaccggaacggccagccattcagataaaaaaaaatgattcatatttaaggtttcccagccgccgaacacagctcctgaaataactgctccttcgtaggcctgtacaaagcgcattgtttttgtcagctgcataaggcgggggacgattcccataacggttaaaaaagccacaaagcccgcgcccacggtcagccctccgccaagcccgacaaatacaacgaaaagaatgctaacgatcatgcagatctttcatcgtctcttcattttcgtgcattgcgacataatgatcgagatcaagctgataattaaacatctcgacttccagcgggcttggctcttcattcaggcgttttttgaagatgtgattaaaaaagacgatcataccgagaccgaggccgatgctgtatggaatctgaagcagatacgggtattcattccgttcgcccgttatgatttcatataaggcgatatgaacttctctcatactgacatcttcatgaaaattcataatggcaagacatgaaccgataaaaagcaggagccagacaccgacgaataaaacggctgacagctgctttttctggtaatggatttccactatcgtttcagcgccgccgacggcctgtacatcaagcgcgggaaaagcggtatgaatggttttcagcacttttatgatgtccagcacgacgatatttttgtcttttttcgtgaccttatacagcggcagtgccgacagtttttttttcagcttttgctgtcccgcaatctgcgcggcgtcgccgactgtgatgatatctccggtatgagccttcacgcggtggcgaagtctgagaaatattcgtctttccatcttgcatcaccatctttcgggtggttatatatgtagtatgtggttcacttttgttctcattcatcagccgcaaaagaccataaattaccaccgatgcacaaataaaaaaagccggcccgtaaaaggtcagctttccgtatgatccatctgcactttaatctgctttaatatttttttctccagcctcgatacctggacttgggaaatcccgagccgttcggctacttccgactgtgtctgatctttataatatctcagatagacaatgagtttttcccgttcttccaaatcactgatcgcttccttgagggcgattttgtcaaaccacttctcttctgaatgatcggcgatctgatcaagcagggtgatcgggtctccgtcattttcatacacggtctcatgaatggatgaaggcgcccgcaccgcttcctgcgcaagcaccacatcctccgcatcaatttctaaatgatccgcgatttcctggacggtcggcactcttccgtatgtttttgacagttcatctttcgcccggcgtattttattgccgagctcttttaaagatcttgatactttgacggttccgtcatcacggatgaagcgctggatttctccgataatcatcggcacggcataagttgaaaaacggacatcataggacaaatcgaatttatcaacggattttaataatccgatacagccgatctgaaacagatcgtccggctcatagcctctgtttaaaaacctttgaacgacggaccacacaagacgcatgtttttttctatgaggaggtctcttgcctgctggtcgccctcttggctctttttgattaattctttgacttcatggtccttgagctgcgcgtttttgctgtttttcttaacctccacatccataacaaatctccttaattacaaagcgctttgctttttgataggtgttttgttaagcgtatcgtcgttcccatctccggcgaggaatcaatcgtgacatcatccataaagttttccataatggtaaagcccattccggagcgctcaagctcgggttttgtcgtaaagagcggctggcgcgcttcctcaagatccgtgatcccgaggccttcatcacgtatggtcagatagacgacatgatcctccagcgtaacggagatgtacacctttccgtcgcagttttcttcatagccgtggatgattgcgtttgttaccgcttctgatacgacggtcttgatttccgtcagctcatccatcgtcgggtcaagctgcgcgataaaagaagcaaccgttacgcgcgcaaacgattcgttctgactgagggctgaaaattcaagatgcatctcgtttttcatgaagccacccccaacgttaaaagcgctttttgttccgattgttcgaacctgatgattttaaacaggccggacatgtcaaacagacgtctcaccgctggcgaaatcgcgcacacgaccatttctccgccgagctgtttaatttgtttataacgccctaaaatcacgccgaggccggagctgtccatgaaggtaagatcttcaaggttcagcacaatgtgacggatgctgtcagcctccagcgattcagtaaccttttgttttaatgattctgccgtatgatggtcgagttcacctgttaatcgaatacaaagcacggattctttgacatgaaagtcaattccaaggctcatgctcattcctccttgtatgatcggataatgagtgtttcgattttcgggaaagcaattccttcactatgacaaaactagtgcccgttcgccatgattatttaaattttgtccaatctcccatcgtccgcttcagaaaagtgagaaaacccgctttttccatgtcgtcttttgccgtgaccgggctttcaacgagcacctttccgtcttttttcagaacgaggctgccgagcacctctccttttttaaccggagccgttacattgccgttgattttcacttctttttttactttgtccatgttctctccctttttggccagaagagaaatcggctcagatgtggtcagcttgatcagtttctgttttccttttttcacttttaccgttccgacgatttgattccgtttgtacagcgggtgtgttttgaactggctgaaggcgtaatcaagcattttggtcacttgggcgtttctttctttcggggtgctggctccgaaaacgacagcaatgaccctcatattcccttttttagcggtggcggttaaacaatacttcgcttcgcctgtaaagcccgtcttcacgccgtctacacccgggtaaaatttgatcagccggtttgtattgacgagccagaactttttgtctgtattttctcttaaataatcctcatacgttcccgtaaattgagtgattttatcgtactttaataattccttcgccattttcgccatgtcataagcagagctgtaatggtctttttcaggcagtcctgtcgggtttttgaaggaggtatctttcaatcccaattcttttgcttttttgttcatccggctgacgaaatcctcttctgaaccggcgatatactccgccattgcgacagatgcgtcatttccggaagctatcgcaattcctttgagcatttcttttaccgtcatttcttctccgggttcaaggaaaatctgtgatccgcccatggacgcggcgtgttcactcgtcctgactttatcgctcatctttattttccctttgtcaagcgcttccatgattaaaagcatggtcatgatttttgtcatgcttgccggcgccagacgctcccggctgttcttgttataaagaatgcttcccgtatcgcgttcaatcagcacggcgcttttggcttcatgagcgagctccgatgtatgttttccgtccggctttgcaaaagcggacggtgctgatgccgttaataaaatgccaatcaacaaagtggatataagacgtttcatctccaaagccctccatttcataatcctttttattttttccaaatccggtggttttatacgcctcatctggaaaatgtttcgtgttgagggcacaaaaaaacagctgcttccgaagaaacagctgacttatgctgacttatttttgagatcgtgcgactacggctttgacaagcttcaaaaagccgccttttactttttccgtcatttccattacttcttcatgagataacggctggtcaagaatacccgccgccgcgttggaaatgcatgagatgccgagcacgcgtatccccgcgtggttggcgacgatgacttccggcacggtcgacatgccgacagcgtcagaccccatcgttcttaaaaaccgaacctcagcaggtgtttcgtaagacggccccgtaacagctgtatacacacctttttgaacaggaatgcccagctcatcggccgttttttcagccaagcttgacagctctttgtcataggcttctgacatgtccgggaatctcgctccgaattcagcttcgttcggcccgattaacgggttggtgcctgtaaagttgatatggtctgtaataatcatcagatcgccggcgcggaattcagtgttgataccgccggctgcattcgtcacgacgagagattcaacgccgagcgctttcatcacgcggactggaaatgtgacctgatccattgagtagccttcatagtaatgaaagcggccctgcatcgcgatgacctgcacgccttcaagcgttcccatcacaagctggccggcatggccttctaccgttgagaccggaaaatcagggatcgtttcatatgtaagcttgacagctccttcaatttcatcggccaatacgccgagccctgaccctaaaatcagaccgatctttggtgtttctttcacgtgttctttaataaatgcagcagcacgttcgatcttttgtttcaaaaaaagtccccctactgtaatcttgataaaaagctttttccgtattccggcttttccgttttaaaattatcggcaatagttgcgccgatatcggcaaatgtatccgcaagcggcagctgttctgtatgtttgtgctttttgctgtaaacaagaagcggcacatactcccgcgtgtgatccgtgccgtgatggacaggatcattgccgtgatccgcagtgataataagcagatcgtcttctttcattttttcaaacacttccggaagcctcgcgtcgaattcctcaagcgcttttccgtacccttccggatcgcggcggtgtccgtacagcgcgtcaaaatcaacgaggttggcaaagctcaggcccgtaaactcttcaccgagcgtttcaatcactttgtccatgccatccatattagataccgtgcggcgggaagatgtaatgccttctccgtcataaatatcagaaattttgccgatggaaatgacgtctaatccgctgtctttcattccgttcattaccgtgcggccgaacggtttgagcgcataatcatgacggttcggcgtgcgtttgaagctgcccggctctccgacgaacggtcttgcgataatccggccgaccatgtacttcggatcaagcgtcagttctctggccgtttcacagatgctgtacagctcttccagcggaacgacatcttcgtgagccgcaatctgcagcacggaatctgctgatgtgtaaacgatcagcgcacccgtttccatatgttcttttccgagctcgtccagaatcgccgtgcctgaagccggcttatttccgatgattttccgtcctgaacgccgctcaagttcctgaagaagttcatccgggaatccttccgggaacactttaaacggtttttcaatgtagaggcccataatctcccagtgccccgtcatcgtatctttcccgtttgacgcctcctgcatttttccgtagtacgcaagagggtgctccgttttttccacgcccttaatgtctccgatcagtccgagaccgagctgcgccatatggggcatatgtaagccgttcatgtgctctgcgatatgtccgagcgtatttgcgcctatatcattaaaatcggcggcgtccggcgcttcaccgattccgacagaatccattacaattaaaaatacccggttatatttgtattcagacatcataaaagcctccttttcttccatctgtccattgtagcttacagaggtcagacaactcaagtataaaccgtttacattcttgttgacaatgccgattcaaataattagaaccttctctgtattccgccaatccggcaaaaaaagccgcggcccctctggcagcggctcctaagctcgcggatgatactgtttgtacacgtccttcagccttgttttcgtcacatgcgtataaatttgtgtcgtggaaatatcggcatgtccgagcatctcctgcacggcgcgcagatccgcgccgttttcgagcaggtgcgttgcaaaagagtgccggagcgtgtgcggtgtcagctcttttttaatccccgcttcaagggcgatttttttcaggtttttccagaatccctgacggctgatctgcctgccgtgatgattcagaaaaagcgcttcggttacgtttttctttaataatttccctctggctttttcaatgtatgcttctatcgcatgggaagcggcttcaccaatcggcacaatccgctctttccgcccttttccgaagcagcggacaaatcccatcgtcaaatggacgtcggataatttcagctcgatcatctcgctgacccggatgccggttgcgtacagcagttcaagcatggctttatccctgagaccgaacgggctgtcaagcttaggcgtgtccaataaccgctcaacttcgtgaagcgccaatactttcggaagcgtccgctctgttttttgtgtttcaatatgtaccgaaggatctttatccgcggctttttcccttaacagaaattgatgaaaagaccggatcgacgccaaatgcctggcagacgtcttgccggatttcccggagtcctttatatgctttaaatattgaataatatgaagacgggtcacatcattccatgaagtgatctgaagggtttcagttaagaagagagaataacttttcagatcacgctcataggacatcatcgtatttagggacagccctctttcaaccctcacataatggatgaaatccttaatttgatccttcactcttgatctactccccgttttggtaaaaaaagatcaatcggccgaaccagccgtctttctcctcatgttccgttttggccactttgacggcggagccttccggtttatcgtaccgatgatagttttcatactctgaattcacccatatcatagcataatagaacagcgcggtaaaacctgtgaacagaataaacactttgatcgtatccgcggctgttttcaggaatctgcccatctttcgatcgaccctttctttggcggctgttagtacaccttatgccaatttcaaaggcttttatacataaaaacagcaaaaaaccctttcctggcagaaaaggttcataggcttttactctgtttcatccccgcggcagcggtggcagattccgtgaaaagtcaatctatgatctttaattttaaatttccaatcacgttcaatcacttcttcaacgtcttcaagcagatcttcttcaatttcatcgacggctccgcactccatgcacaccaaatggtgatgaaaatgagccgcgccctctttgcgaaggtcgtagcgggatacgccgtccccgaagttaattttatcaacgacttttaattctgttaataattctaatgtacggtatactgtagcgagaccaatttcaggagatttctcttttacgaggaggtatacatcttctgcgcttaaatggtcttcttcgttttcaagcagcactcttaccgttgcttcccgctgtggcgtaagcttgtagcttgacgagtgcagctgctttttaattcgatcaatacggttttccatgtctttccctcctacgccgcattccatgactcattataacaaaatacgcgcagagttccaactataattattataaactgataaataaaagtattattttgtgataataattctaaaatatgcgtgatgacagcttttccataaacagcggagacatgtacgcttcgagcagtgaagcgaggaccgagaagaaaacgatgagaatcagtacgaaggcgtagcgtccgaaccattggatcggcgcgtcatgaaggctgcgtttgacaaacagctgccggatcagtttcagtgaaaaagcgatggagcatgtccccatgataagatatgctggaatgagaacgatgttttgcggcagaaccgaaataaatgacaggaaaaacccgttcatccccatttgattcactaaaaaaccgaccgtgaagccgacgacgattccttttaagaacaccataatgaaaataaccggaagaccgatcacggaaataccgagaatccacatcagccccaaatattttacatcatgaaagacggcctgccaaaacatttctgaagcgccggcatgttttccgtcagacagctgtccgaaaaacttgcttaaatagtaatacaaatcttctttctgcgtgatggtcatgctgttgacgatgatcgccccgaaaatgacccccatcaaaaacaagacgaacacaaatatataaagtgacagatgatcctttacatggcgaaaaaacagttctttgtacgattgttttctcataccgctttcctcccgctaatctattgacttgatttagtagattgtatgaaagaaaagagaaaacatgacagagaaatcatagaaaggcgcgagattcgggcataaaaaaagaacccccgtcatcactccggtgatcataggggttcctttttttatgctttattctttcaagcctgtcttttttagttttcgtcactctttcatgggtgctgaaaggcggcgccgtcccccttgacaagactgcgtcacgcatcccgtttcttctgagatgctcccgcatttttttcgttttgctcttcgccatgtgccaatcgctcctttttgccttttctttatcataacaaaaaaatcccgatgtgttcatgaatacggctcatgtttcgaccggtaagcgcgcagagacgttttggcagatgaatagctccccatagcggcgtatccgtaaaaaaatcccatgaaaatccccgcatacacgtgttcatggtgaccgaaaacgatagacacaacatttccggcagcaagggcaatcgtgggaacgaatatgcccggaacccggcagaacactttgatcagctgtgtaacgcataagacgaccggcacgccgatcacagcatcccaaatatttgtatggatcagcggaaaataatccacattgacacctctttattccgtcttttgctatctgttagcctgcctaagaattccgtttcctattcatctaaaaaaacagcaccggcacatgtccggtactgtaagagttgtttattttcctgccgcggcccgttctacggctgctgatacagcctgatgcacgtccgcatccaaaggctgaggcacgagatcgccgtgttttgtgcaagaggcgatggcttctgcggccgccacaagcatttcatggtcgattttcttgcttttggcgttcagcgcgccgcggaaaatccccgggaagccgagaacattattgaccgagcggccgtcggctgcataagcggctccggcttgtaatgcgtcttccggttcaatctccggcttcggattagataaggccagaatgacatgtccttttctgacatcctcttttttaatgagacccggaactccggtggtgctgatcacaatgtcacacgtgtccattaaatctttgatgcttccaagcggctgacctccgtactgagcgaggcggttcattgcgtcttctgacttgtccgttccgcagaccgctttgactccgtatgccataaacatccggcagatggcgacgcctgccgcgccgagaccgatctgtccgaccttcgcttcttttaaatcaagaccggcgcttttacaagcggaaatggcggcggcgagcgtgacgaccgccgtgccgtgctgatcatcgtgcataaccggaatatccagttcttctttcaggcggtcttcaatgtcaaagcagtgaggcgaaccgatatcttcaagcagtattccgctgaaccccggagaaatatgttttaccgtgcgaataatttcttccggatcagaggtatcaagcaaaatcggaattccgctgatacccgccagctggtcaaaaagcgcggctttcccttccattacaggcattccggcgacagaaccgatattgccgaggccgagaatcgccgtgccgtcggtgacaatggcgacagaattgctgattgtcgtatagatggacgctttttcaggctcgttttcaatcagtcggcacacatcggcgacgcccggtgtataaacacggccaagctcagccaatgtccggatcggcattttgcttttcatttgaattttgccgccttcatgagcagagagcacttcatctgagactgtatgaagccggatgccttcaccgagagcttcaatggcttgaatgatttcctgcagctgctcctcattttcggcctgcaccgtgatgttgcgcattgtgtagttcgggccgactttaacggtttcaacttccccgatatctccgcccatcactccgatggcggttgccacttttccgagatttccgggaacagtcggcgtttcaatcattaacgtccgaatcatatgctttgtaatcatgaaatgaacctcctaacccaatttttgagattgcaaggatttttctttcgtgtaccaaatgaatttccccgtgtatccgtacaatattgccagtccgatagatacaaaactgagccacatgaacggcagatatgaaaatgtggatacgccgagaatgccggccatatagatgccgttatcagaccacggcaccatccctgaagtaagcgttccgcccacctctgcgttccgggataaaactcttctgtcaagtttcagtttatcataactgttctccatgattttcggcgtcaggatcaatgacacgtacatcgcacagccgaaaatgtttcctaaaagggcgacgatcaatgtcgaaagcgtcacatttcccggtgtggtcagctttttctcaaaagttgagacaatcacttttaatacgccgagcttctcaagaattcctccaaaaccgagaccgaacaggataacgactaacgtatccagcataccggtaatgcctccgcggtttaacaggccgtttaaaaattcgacgtccgttttaatagaaaaaccattataagcagtcgcgatggcactggcaaaattcattccctgaaagacggaagcccagattgcgccaagcaaagcaccgatgataataacgggcatagacggctttttcaaaatcagaaggacaacgacgacaacagccggaatgagcatccatatatgaatatcaaacgttttctgcaatgaagattttaaaaattccactttgtcgagatcaatattttttccgccgtatataaatcccgttacggtaaatagaatggccgtaataatataggacggaattgacagatacatcatcgctctgacgtgcgacagcacatccaccttagaaagcgtggaggcaagcaccgtactgtcagacagcggtgaaagcttgtctccgaagtaagcgccggacaaaacggctcccgctacgatcggaagcggtatacccattccctctccgatggcaatcatggcgatccccgcggttcccacggttccccacgatgttccggtcgcaacggacataacggaacaaataaccagtgtagccagaaggaaaatatgaggattaataaactctaaaccataataaattaacgtcggcacaacaccgccggcaatccatgtcccgatgagcgcaccgaccgaaacgagaatcaacaccgcttcaagaccgtttgatatcccggtgacaatcgaatcctgcaagtctttatatgaatatcccagcctgactccgagaataatagcgaaaaaccaggatattaatagagctagctggatcggcaggtctaaaaacactgtgaacgataagacaagtgctaaaaacccgaataataagataataatttccaataaatttggcaatctgacctctttcacaagaaaatccccctagaagaaaaaagctaaaacgctttcatcaaatgatataacaaattatactatactgcctcatccctttgtatggcaaccgcctattcactgaaaaacgtgaaaaggcggctgttgttgctttaaaatttatttttctaatagatcttttccggcaatccccggttttgtcatttcatacggattcaaaatgatatccaattcttcttctgtcagtacatcattttgaaggcaaagatctcttacagattgccccgtcatgatggcttcacgggcaattcgcgcagccgcttcatagccgaggtgcggattgaccgctgtaatgacgccgacgcttttttccacgtattgcttcagacgtttttcgttggcttcaattcccgccagacaatgatcggtaaatgaacggaacccgttattcatgatgctgatggattgaagcaggttaaatacgagtaccggctccattacgttaagctccagctggcccgcttctgaagcgaggcagatcgtattgtcattcccgatgacctggaaggcgatttggttgatcagctctgccattacagggttgactttcccaggcataatggatgatcccggctgacgggcgggcagtgaaatttccgcaagtcccgcgcgcggacctgaagccattaagcgcagatcgttggcgattttagacatgttcatcatgcatactttcaacgcggctgaaacttccgtatacgcatcagtgttttgtgtggcgtcaaccaaatggccggcgccgacaagcggcagtccgctgatgtcagccaggtgctttacaacctgttctatgtagcgcggatcggcattaagccccgtccctacggccgttgcccccatgttgacttcatacagatgctggcgggattgtttaattcgctttatgtcacgctcgagcacgcggctgtatgcttcaaattcctgtccgagacggatcggcacagcgtcctgaaggtgtgtgcgccccattttaatgacagaatcaaattgtttcgctttatccttaaagacactcagcatatgcgccatcgtatcaaggagcttatccaaaagttttaaggtggaaatatggattgccgtcgggaacacgtcgttcgtcgattgggacatgttgacgtgtgtgttcgggctgaggtgaatgtattcaccttttttatggcccatgatttcaagggccctgttgccgattacttcgttggcattcatgttcatggacgttccggctcccccttggatcggatcgacgatgaattggtcatgccatttcccctcaagaatctcgtctgcggcctggacaatcgcatttccgattccttcatacagccgttttacatccatgttggcaagcgccgccgcttttttgacgatggcgagcgcattaatcatctcttcgtggatgcggtagccggtaatcggaaagttttctttcgcgcgcagcgtttgtattccgtaatacacatcagcttcaatttgtttttctccgaggaaatctttttcctgacgatattctttttgcgcgtttgtcatgctaaaaccctactttctctttgtggtagtcatgtttttacagtacaacgtcgtctgcgatcggtgtctccataatgtttttgacttcagccaagttgtgagactggccgagcgcccacattaatttcggcacgatggcttccgtgttcatatttctggagcggataatgagatcttgattgactcttcggccgacttcatagacgctcatgtcctctccttcttcaagacattgtgtcgtaatgacgacgacaatgccgctttcaatcatttcattgactttggcgagaatgtctcttccttcaaacggcacgccgccgctgccgtagctttcaatgacgatccctttgtacatgccctttaatgcgtcaaacatttccggtttcagccccgggtggagcttgagcaggcacacgtccgtgcaaagtgaggtattgaccgtaaaggcatcgtcttttggcatgtgcacttgtttgttgtattcaattccgttttcggtaataaacgcgatatacggatagttaatgctctcaaatgcatcatagcttttcgttcttaatttaatggcgcgtgtgccttgaatgactctgccgtcaaatacgacgtatacgccgcccaccccttcacatgcgaagcggatcgcgtccgtgatattttttttggcatcggttttttgaaatgtaatcggaatttgcgaacccgtaatgacgatcggtttatcagcatgctgaagcatataagacagtgccgctgatgtatacgccattgtgtctgtcccgtgcgtaatgacgaacccgtcatatgcgtcatatttttctttgacagcatttgcgatttcggcccagtattcaggctgcatatttgtgctgtcgatgttcattaacgaatgggtttccatcgtgtaatcgttatcaagttttgatacgtaggttaacaattcgtctgctttcaccccgggtgcaagcccgttttctccttcgactgaggcgattgttcctccggttgttaacagcaataattttttcataccctgcacctcttcatccatttctcaagatgtgttaagcattcgcttttcgcatacttttaatcaaattatagacagacgattgaaattaatcaagtgattattattcaattcgcgtacacttttgcatatcgatatgatataatttgctcaagtgaaaaggagcggttttgaatatgaatttagatcgtttaactgaactgagaaaaaagaaaaattggtctcttcaatatacggctgaccgtctcggcatcgccaaaagcacgtacgccgggtatgaatcaggataccggcgtccgtcattcgaagcgctgggcacgcttgccgatctgtttgacacgacgtgcgacgatttactggggcgcactgaaaaaaaggcggagccgtttacccagaccatcgaattaacaaacgccgcacaaggccgcggcacactgaccgttgacggacagccgctgaatcaggatgaaatcatcgaattgattgcgtttgtccgcacgaaaaagaaggtgcaggaggagctccgctaaaatccggcttttacgacttgattctgccgtacgtccctccgcccccggcctcaaggacgagctgcccggtgcgcgctttatgaatgacagccgctattttaggctggacgacatgcgccaattcctcttcttgcgcctgatgaagaatcgccatctccgtcccgaaagcccgcttcagtttgtctaacgttttcggcccgacccccggaatgaactgcagcgggatttgatgaatatacggcggccgcggcacgcggctttttttcgggccgctcagttcctccagccgttcactgaccccttttgtcatagttttccccccgcactccggacaggcggaagctcctttttcaaccgggctgccgcagcggtcgcaagccgtccggtaatacttcccgagcttcgggttcagcccgtaattcgccgtgatttttcttccgtccttcccttttaaagccagcgaaaattccgtgaaattcgcttctttaagaagcatttcattatattctctgccgatttttcctaaggaatgcgcatcagaatttgttaaaaatgtatacggatcaagttccgttacccgcgaagccatgtcggtgtcgcagcttaatccgagttccgccgcatcaatgagcgccgggtcgaaaacttctgtcaaagaagatatgaccccttttccgtacaggcttttatgcggggtgaacatatgggcgggaataaacagcccgcccaattcctttgttttcctttgaagattcaaaccggtttcataaatacgctgggaactgagatggatatttttaagcctttttgcgagccactcagaaaacatcttcatttcggcaagagacggcataaagacgagaacgtgaatcggcccgcggcatgtgtgatcatagatttcaagctcactgcccaacagaagcgtcgtattccgataccggatgccgccttctttcagctcacggtatctgccttcatcaattccgcgctcgatttcttctatgacttccggggaatggcagtcgatgatgcccaatagttcaattcccttcccctcactggcctcttctaaaatccgatgcagcgtcaacgttttggccccggtgattttgaccggttttcccgtataggtgcggccgatatgaatatgcagatccgcatagatggttttcatcatttttccttcagtgcttctttcagctgcagatactgaatcgcgtacgccgtttttgcgtcatacaccctgcgggattcaatcagcttcacggcctcttcaagcgtgacctgcatgacttcgacaaattcatcctcatccagttcgcgcttttcttccagcggcgaaagcccttccgcaagaaagagatgcacgatttcatcagcaaacccgggtgatgtataaaaagcggtgattttcgtcaaggtttccgccgtatatcccgtttcttcctcgagctctcttaacgccgtatgttccggctcttcccccttttcaagcttcccggccggaatttcaacgattgtccgttccagcggctttctgaactggtttaccaaaatgatttttccttcttcggtcaccgcaagtacggccaccgctcccggatgtttgacgatttcccgcttgcttgtttttccgttcgggagctctacatcctctaagtaaagatctatgactttcccgtcatacagcttttttttcgcaagtgttttttcttctaaatgtttcatcatgtcatctcccgttctgtctctctattatgcctcatatattttatcatacatgcatgagagggaggtgcttttcgattgaaggtgtaccggaaggataaaagtatcgtattggtcggaaaggcgtgggaagtgcgggctaaactgaaagaatacggacggacattccgctatgtcggagattggatcaccgggccttaacagttgaaaacttcgcgcctttatattacggtcaataaaagactataaaaaggagcgaaacgatgagaaaacgcacactgggacattctgatttagaaataagcgaaatcgggctcggctgtatgtcgctgggcacggataaagctgaagcgctgtctattttggatgaagcgatcgagcttggaatcaattatttagataccgctgatctttatgatttcggcagaaatgaggaaattgtcggggaggccgtcaaaaaccgcaggcacgacatcattttagccacgaaagccggaaaccgctggaatgatgataaagacggctggcattgggacgcctccaaaggatacataaaagaagcggtcaaaaacagtctgcgccggctgaaaacggactatatcgacctttatcagctgcatggcggcacgatggaagatcatattgacgaaacgatcgaagcgtttgaggacttaaaacaggaaggcgtcatccggtattacggcatttcctcgattcgtccgaatgtcattaaagaatatgtgaaaaaatcaaatatctcaagcgttatgatgcaatacagcctgctggaccggcgtcctgaggagtggcttccccttttagaggagaacggaatcagcgtagtcgccagagggcctgtcgctaaagggcttcttacggaaaaaccgcttgatcaagcagccgcaagcgtaaaagagaacgggtatttaacatattcttttgcagaattggaagaaaccaaaaaagcgatcggcgctgccgcacctgacttgagcatgacggagctttcccttcaatacttactgtcacagccggccgtcgcttctgtcatcaccggagccagctcacttgagcagctgagagaaaactgttcggctgcagaggcccggcgtttaagcagccaggaaatcaaagccctgcaataccatacaaaacgggacgtatacgaagcccatcgttcttaaacaataaaaccggcaccttgtcagatgccggtttatttatatttgtgccaatcgagactgctttcattcagcagctcttcaaagcttttatgtttttctttttcttttcgctttctgatttgttccgctttttgctgcgcctgttttttctcgtcttcttccttcagctcacttttcatttgcaaaagcctggccttcagatcttcctccagatcgtcttttaagctgtgtttttctttaggcagctgctttttcatcattacgccccccgtatctgaatatggtgaagcaagtgtaccacggagcgccggaggccggcaacgttcacggtcctgaaaagccggaggaaggatttttcatatgaaaggagggcccctgtgtgaaaaaatggctggcggtgttcggttcggcttgcgcagtctttttggctgccggattcgcttttacgaatctcattatgtttatgaagaaaaagacggatgaagatatcatgaaaaaagaaacggcggacgggcatgatagatttgattcctttcaggccatggaaaaagaagaggccgtcatcctgtcacgccacgggtatgagatcaaaggcttttacgtcgccccgcatcatacggcaaacgccatgattatttgtcacggcgttaccgtaaattcgttcaattcattgaaatacatggatttatttttagattcaggctggaatgtgctcgtatatgaccaccgcgggcacggaaaaagcggcggcagaacgacgagctacggctattttgaaaaagatgatttggaagaagccgtgaattgggtgagacacaaaacgggagacggcggtcaaatcggcatccacggggaatcgatgggagcggtgacggccttattatacgcgggcgggcatcaggatgaaaaaggcgctgatttttatattgcggactgtccgttcgcaagctttcgcgatcagctcgcctacagactgaagcgggagttccggctgcctccgtggccgcttctgcctttggctgatttctttttgcggatgagagaaggataccgtatccgtgatgtatcgcctctatcggttatcagccgaccggcagcccgtgctgtttattcacagtaaggaagatgattatatacctcccgcttcttccgaattgctgcaccgcagaaaacgcggaccgaagatgctctatctggccgaatcgggcgggcatgccatgtcgtacaccaaaaatccggagagctaccgcaaagccgttcaaacctttttagataccatgacgcaaacgtaaaaaagcgaaagaacgtatgctggttctttcgctttcccgtcataaaacgtcggtaatcccgtccatattttctccgatccagtcaatggcgaggtcgattgtcgtaaactcctgcgctttgaaggtcatctcatcctgaagcagccagacatccttctgaacggattcagcgcctccgatggaccagtgcagcagactgtacgggtggttgttgttcagaaaggatacccacgttttatgctgtgccgtctgtttaatggctttcagcttttgattcactttccgtttctccctgctttactaatatgctcattctcgggctcagcatctctgccgggctttttaagacgagcgtttttgccttttcattgtaatcgattgtcatttcctcgtcaaaaaacactttttgtgaggtctggatgtaaagcggaagtccgttggtttcaatggcttcgcattgtcccgttaattcgtccgccagccagatggtcggcacgccgctcaccgcgcacccgcagccttctgcgtcatagcggagctgcgcttttttccccgggttggcgtccatcgcctgctgaagtgtgtgtttcgccgcatccgtcacatgtatttgcatagatgatcctccgtttttcattttcgccattgtagcataccgagccgctgtatgcattgtttctgctttctttacagaagcccgctctcccagtcctttgcctcttgttcagccgccttgatccagtcatttttcccttcactatactttgccgtatcgtacgggtatgccttagcgagccgccgtttcagttccatgtattgagccgctttttcaggcttttcagtgaggtaatcccggaacagcagatggcgcttcacatccggatggcctgtttcgtatatgtggacgtggtgtgtgcgcttgctgccgcctttttgaaagaaacgccggccctctatcccgttttccccttgcgcctcatagccgagtgcttccagctgcgggctgaatcggtcagcatctgaaatatctttgacctccgccagtatatcgataacgggttttgcggccattcccgggatggaggtgctgccgatatggctgacagaatgaagtgcggggccgaagattcggatcaagtccgccttctctctttcaaacatctctttccattccggcttgtacggaacaacttccgctttcctcttcggataaagatgaaaaaacgagagggtcagcccttccggcgtctctgtctgtccggcttctgtgaagccggtttttaaatagagagagactgccggaacgttttgactggcggtagccgcctctattttttgggcgtcccggttttggtcgatcacaaattgaataagcgcccgtccgattcctttccgaaagccggacgggtgcaccgtcagcctgcatatgacaaggtcatatccttttttttcatacgaaatgacgcctgcaagccgatctttttctctgaaaccggcaaacgtctcccgtgaccgctgtatgtcaccgggtgtttcatgcagggctggaatgccgaaaaagccgatcagctcggcttctttttgataagagcagcgttgaaccgccgcaatttcccgcgccgtctgttcttgtgtatgccgtaaaaatgtaatcaatcttccgccccttttgacgcaaacatccgctgtgactccgtcttcgtaatgcggaccgcgtacgcttcataccaggcgctttttcctttttgttttgccgcccggtggtcagtatggtctttccaccttttaatcgcctccaggctgtcccagtaggaaaccgtgatgccgcagccgttttcctcccgaacgctttccgcgcctaaaaagcccggctgtccgcctgccaaattcatcatgcgctctgccgtatgctcatattcctcatcatattttccctttattgatgaaaaaatgaccgcataatagggcggtttgggcgtgtcagctaaaaaacccatattcatccccctctacatatatttcacaaacagaattctgtcttctcccggaccgtcataattcgcaaaaacagggattccgtttacggttttggttcctttttcaacttcaaagcctaattttgtatgataagcgattgatactttattcacgggcgccgtcacgcaattgacttttgtgcagcccctttttttcaccgtctccataaatcgatcgtagagctgttttccaatttgcatttttctgaaatccggatgcacaccggaaaaatgaatgtaggctgtctcagggtctgattgtgactgaaaaccgattaaaaaaccggtcattccctccggcccgtacgtgataaagctcgtgtcctgaaaatgttcaaaaaacaagcgcggcagtttgtctttcatctgcctgccgccccaccattcattcaaaacagacgtaaccatttcatagtcttcagaggtaattgttcgaatatccattatcgattgactctccttttcgtccggcaaaatgaatgtcagctcttctcattggaatataaaaaattatatgtgggttgtttgcaattgtaaatgatttcttttcaagcaaacgaatcagcacgtcttccagccggggaatgatttaccagtataaacgtgatcattgttcgggtacaatgaaaaacagaacaaacgttcccggaggtttttttatggctgatattcttcttgttgatatgcaatcgttttatgcgtctgtggaaaaagcggaagcgcctcatctcaaaagccggcccgtgattgtctcgggagatcccgaaagacgcagcggcgtcgtgcttgcggcttgtccgctcgccaaacgatacggcgtaaaaaatgccgaacggctgtgggaagcgcaggccaaatgtcccgacgccgttattgtccgtccgcggatgcagcagtatattgatgtatccgtcatgattaccgaactgtttgaacggtataccgatcttgtagaaccctactccatcgatgagcagtttctcgacgtgaccggaagcaggcggctgttcggtgatccttttacaattgccgaaagcattcagcaagcgattatgcgtgaattcggaatttatgcccgtgtcggcatcgggccgaataaggcgctcgcgaaaatggcttgcgaccattttgccaaaaaaaacgcatccggcatccacagattggatatgtcaaatatcagggaggatctgtggccgctgccggtcggaaaattattcggcatcggaaaacggatggagcatcatttaagacggatgggcatcagcacaatcggcgggcttgccgggcaccccgccgaactgctgaaaaaacgctggggcattaacggcgaattgcttcagcggacagcccgcggcatcgatccctctccggtcaccgtcaacacgcacagccggcaaaaagcgatcggccataacatgaccctcccgagagactacagccgctttgaggatatcaaagtcgtgctgttggagttaagcgaagaagtggcccgccgcgcccgtttcaaacaatacatcggccatacggtttcggtcagcatcagaggcgctgattttgaattcccttcaggttttcacagacagagaaagctggtctctccgactaatttcggaatggatatttttaaagcggcggtcaagctcttcaaagagcattggaacggtgagcccgtccgcagcgccggcgtctccctttcccagctggagccctgtgattatgttcagctgagcctgtttgatgctcaggaaaaaaagatcagtctcggcaaagtattggatgatattcatgagcggtacggccctgcgtcgctcctccatgccgcttcgctgacagaggccggccaagcctttcaccgggctgaaaaaatcggcgggcattacaaataattgaggtgatatacatgaatccgaacaaattaacacccgggtataatgtcatgtgggaatcaagccggatgatgctgcccgaacatcgggagcagctgcttgcaaaaaaacgaaaagaacgggaattccggcctccggaactgagcgcagagcaactgaacgacatgaaccgcatcattgcggcgtcgattgaagaagacagagccatctcggtcacctatgcttcagcacgcggcccccgccgcttttggggatgggtgaaacaagtgaggcatgacgaaaaacgtttaaaaatcataaacgatgaagatgcgttaacgctgccgtttcatcttattctctcggctgaactggaataaaagcctaaatcgtcctgacagaaaatatgatagaagagtgggaggatcacatgatatttagtagaataaagatgaatgacaagaataggagaatatatgatggatcaatttatagaaaaaatgctgggacaagccctccgccagtatggacggaatgtgtcgacagatccgctgagcccctatgaaaaacagagtttaaaaaaagctttagaagaaagaaggaatgaagaacccgatgaggatctccatgcccatgtagaagatattatctacgattacgtcaccaatcaggggcagttttcctgacacggacgtttatgcaccgggcgaaaagggaaacgtccgagagtaaaccctaaagattgcgtggtgcaggatatgcctgtcgggccttatttcaagatcggctatgccgttcttctgttatttctcatcatttatctcggaacattaatagactttttgttccagcctgttgtgattacggttaaaaccttgtttccgcccattgtattatcgggtgtcctttactatttgtgccgcccgctcgtcagagtgctgcatgcgaaattaaagctgccccaaggaatcgcgattttagcgatttatgcgggaacagccggcctttttgtcctcttcctttatacggcgggccctgccgttcaaaaacagtttacagccttcacagaccatattccggagctttccgcaaaagctgaaaattggatcgggcatcttcaggacagcaaatggttttccaggcttcagcatggggattcctttaaaaaattagcggacaaagccgcaaattattccggttcaatcgctgattctctcagcagtctggccggtacggctgccaatgccgccatcaccgcagccattattccgtttgcgctgtattacatgttaaaagaaggaaataaagccccccggcgactgctgcggcttcttccggaaaaacatcaaaaagaaggaaaacaaatcctgcgggatatggatgaagctctcagttcatacatacaaggacagctgctcgtcagtttctgtgtcggcgttctcgtcacaatcggctattttatcatcgggctcgattatccgctcgttctgggcgcgttcgccatggtgacaaatctgattccgtttatcgggccttggatcggcacatttcccggagtcattgtcggattgttcgattcaccgaccgaggcggtgctggtgattacggtcgtcgtcattgtccagcagcttgaaagccagctgatttccccgcaaattatgggacggaagctggacattcacccgctgaccattatttttcttctgcttgccgccggcaaattctcaggaattgccgggatgctgctggccattccgggatatgcggccgcaaaagtgatcataagccatatgcagaaactattcattctcagaaagaaacaaagctaggagagaaatgattcatcccccatgtcttcacatcggttaaaatgaaaaaacggcgggctgaagaagcccgccgcacacggaggtaaaaaagatgaacatcggtgatgtcatttttcaattgatctcatttattgcagccgcatttttcctgtttgccgtgatatacgtattcagaagcttgaagcagcgccgcatacaattggacagaatcgaaaagaaactcgacgcgctgcgcgaagaaaaaaacgagaagttatagttcattcagaagcaggcgcagccagctccacctttatccgatccgggtcctccgtgtatacggcgtaatgcgtgcttccgcctgcatatggatggcggtccctgtaaagcacggggcatcctctggcaagcagcttttccgtcatcccgtcaacctgctctcttgacgcagcatgaaaagccagatggttcagcccgacccggcatctgtggtactccggtgttaaaaaacgctcctctgtctgtacaagcacaacataaaatccggcgtttttccagctgatgccggagtcccaattttgaaactccctataaccgagctcacctaaaaaccatccccaaaaccgggcggaggctttcaagtcagatacatacaattcaatatgatgcatcataatattcgcttcctcctcacatcacacccgccttaccagcacctcttcaactttatggccgtcacctttcctcaaaatcaaatccgatctgaattttgtcggcaggatattttcatacagattcggacggttgacgctctcccagatggaggcggccatggtatccgcttctgcatcagacaaatccttaaatttatgaaaataagaagccggatcttgaaaagcggtttctcttaagaggcggaaacgctccaaataccacgtgaaaatccggctttcttcggcatccacatagatcgaaaaatcaaagaaatccgatacaaaaatccgcggatcttccctgtcgtcctctaaggtcggcgactgcaggacattgattccttcgataataacgatatccgcaccttcgacaacctcgacggcaccctcttccctgtcataggtaaggtgggagtatacgggcgcctccactctctctttccctgactttatatcgttcagaaactcaagcagcgctttcacgtcgtaactttccggaaatccctttctggacagaaggtttttcttttttaattccgccgtcggatacaagaaaccgtcggttgtcaccaggctcaccttcggcctgtccggcagacgggaaagaagcttttgcaaaattctcgccgtcgtgcttttgccgacggcgacgctgcccgcgattccgatgataaacgggattttcgctgaatgcggatgtttcagaaacacgttgacatgctgattccgtcttgcggcagacgtgacatgaagatggagcagtcgcacaagcggaatataaatcgtttctacttcttccaccgacaggtagtcattcagcccctctacggccttggcttcttcctccgaaacggcaatggaaagatggccgccgaatccggcccacgactcgcggctgtgctgcgtatacaatgtatgtaagttcaattctttacttttcacaattcacaccaatctctctgtatggctttccgattaaaaaacaaacgcttacaaagattgtaacggaaaaccgcctcactgtctgcccatttttttcacaaatgaggaaccgatccggctgtactcttccatttcctccttgggaaccatgcttccgccggtaccccacacaaggtgcacggcattttccatctcaagcccccgctcttttatataacggttaccggcttcggtctgaacgaacttgacggctccggccataccggcgagtgcagagggttcaaggctcttattctcggccgctcttaattgataaagcagtgaaaaaagcgtgccgtcatcagcggtataacagccgctgagtacaggctccatcagagggccggccagtccggacggccttcctaccgcaagtccgtcggcggctgtttgattatcaaggccgatatcctgcacgctgattccgtcatgcaagccggaaaacagtcctaacagcatacagggtgaatgcgtcggctcaccgaaaaaaatatggacatgcccgccatagatcagctttagcgcaagcgcgacgccgcccgggcctcctccgaccccgcacggcaaataaacgaaaagcggttcatctgcacccggctttatgttcatttgatcgagctgctttttcacacggcttcccgcaacggcataccccagaaacagatcccgggaatgctcatcatcaataaaataacaataagggtcctgcttcgcctgcatgcgcccctctttgacagccagactgtagtctgcttcatattcgatgacgcgaacccccttttcccggagcagctcctttttccactgctttgcgtcactggacatatgaacggtcacacaaaagccgagcttcgcgccgattatgccgatactcagacctaaattgcccgtagaaccgacggctatagagtattttgagaaaaaagcggtaaaccgttcctcagtcaatatgctgtaatcatcgtctgttgagagcattcccgcttttaaagcgagatcttcagcatgcttcagcacttcataaatcccgccgcgcgctttaatagaaccggaaatcggaagttcattgtcgcatttcaaaagcagacgcccggggaaagcctgagcggcgctttgttccagacgctttttcatttcattgatgaagacaagcggagactcaatgaggcctcccgccgcttccgtctccggaaaagccgacgcgatataaggcgcaaaccggcgcagcctttcttccgcttcggcaatctcctttctccattcagcgccattctttactggatcatcggttttatgcgggttgatccaaaatacttcacgcgcctctgccatttgcctgactaaaggctctgtcatcaatgccttgtgtatatccaggtcggacattcctttctcccccttgttactttttctttaatgcgcggccggccagtttttctgtaaacgaagggaaaagctgatacagcttcgtcccgaggctcatccatcgcggaagattcatttcccgtttatccgtcagaattacggatgtaatacgctctgccacatggtcggcatcaagcatccatctgccgacgcttttcacataaccgccctctttatctgcaattgtaaagaagtctgttttgatcggaccgggattaaccgttgtcacggctacacccgtaccggccagctcaagccgcagcgcattggaataccctaaaacggcgtgtttcgtagcggaataaaggcttgatttcggcgtcgccaatttgccggcctgtgaggcgatattgataatatggccgcttttcgcatgaagcatcaccggaagacaggccttcgtacaggcgattaatccgaagacgttcacttcaaacattgccttcatatcctccaaagatgaatcagcggctgtttcaaaaataccgaagccggcgttgttgattaatacgtcaacatgaccgatcaaacgccttacgttttcagcctcttctgcatgccggacgtcaaacggaatgacatcacactgtccgccgcgcgcggtaatcgtttttttcacttcctgcaagcggtcctcccgcctggcggataaaaaaacatgagccccttctgccgcgcaggaatatgcaagccgttctccgagtccgccggatgctccggtgatccaaatccgcttatccgttaatctgcccatttccttcaccccttcacagctttaaacatcagagtatttcccgactgaaaggattcagcctccccttttgcagccagtacgtcaagatggccgatcgtttctgacatcattaaaaacaattcattttcatacacagccggaaacagccgccggcatacctggaaagccgtcagcgtttcctctgacaacaggcgcagcacatattccgaccggtttctctgtttttcaagccgcctgtcaaaagcaggctttacgtccgtcagcagatcgccgtgtcccggatataaaagggacgggtttacgtcatacagccgcttcattgagttcaagtagtcgagcatcggggccgcgcgcacgccccccttttccggagcttccagaatcggattggtggagctgttggacaaaagcagatcgccgctgaacatttcaccgcttttttcatggtagagcgcaatgtgagaagcggcatgacccgggatttcgagcaccgtccagccgttaagcccgtcgattttcccgccttcttccactgttttcgttaacagacggtttgcagaaaataagtacgacagcttaactgttttctgtatgtcttcaggcgtcaggggaacgcccatttcagtcataagcgacagaaaaaagtcctcctgccgggcgatatacgactgatcctgagtaatgtacctgtcattcagcggatgcccgatcacttccgtatcctcggaaaaaaggtgcagcagacctgaatgatctgcgtgatgatgagtgagcaccacctgttctatatccgccgcagaaacgccgtgttccttaagctgaaatgagagcgattcagccgcttcctttgtattcgggccgcagtcaataagggttaaggcttcatcttttattaaataaacgataacgtcgccgactgcaaacggagtcggcacacgtatcggaatgatctttctcgctgccatgtttacgctccttcgttcttttcattcctgaataatcatattttagcgttttcttttcactgtgtcattattgcgcatatcggaaaaaaagattgacatcccgctctttcgcatagcataatgaacaacaaactagaaaacacggaacgcgatgacgaggaactagtatataaacaacggcagcagagagcaatgtccccggctgaaagacattgcggccctcttgtttacagaacctgccctcagagcggttaggaaaacctaaacgtatccctcgttacgggatttgagctgagcacggctgattcgtgctaatgtaaggtggtaccgcgaaaccttttcgtcctttttgacgggaaggtttttttgtgttttagaagaaggaggatttatatgaagaaaatcggttttatcggggccggatcaatggcggaagcaatggtgaacggactgctgcaaagcggaatgacagcccccggacatatatatatgacaaaccggtcaaatgacagccggcttgaagagctccaaaaaacgtacggagtgaaaccgtgccgggataaagaagagtttttcagcaataccgacattattgttctcgcctttaaaccgaaagatgcggcagaaagcattgagaacattcgcgaatacgtgaaagatcagcttgtgatttctgtcatcgcggggctgacgattcacacgattcagcaatatttcggcagaaagctcaccatcatccgggcgatgccgaatacatccgcggccattcagcaatcggcgaccggtttttccgcaagctccgaggcgagtgaagctgaaatccggacggcaaaagagcttctggaaacaatcggagaagcgacgctctttgaagaaaaacaccttgatgccgtcacagccattgccggaagcggtcccgcctatgtgtaccggtatgtggaagcgatggaaaaggccgcccttcaagccggcctgccggaagaaacggcaaaagagctgattttacaaaccatggccggggcgacggaaatgctcagaacaagcagcaaacggcctgaacgcctgcgtaaggaaatcacaagcccgggcggcacgactgaagcaggccttcgcgcattagacgagcgccgctttgaagaagccatcatgcactgcatcgcagaaaccgcagcccggagcgccgaaattaaagaacaattcgcaggctccgttctgcaaaagacggaccagtcataaagcatgggggcatcccatgcttttttcattctgtttaactgccgtataagcggctgattctctcttttacttcaggaagatggaatgtggcttcgtgcatgtttacctcttcctcaaccgcttttgtcagctctcttttgatccgtgcggtcacattggttttcagcgcaaccagtgaggctctcggtttatccgccagcagccgggccaattcgcggcctctttgaagggcgtcttttttcggcagcacttcaaacggaacaccccgtttttccagagcggcgccgctgaaattcgcggccgtaaacagcatttcttccccgaggacaattcccagtttttcaggcacaatatacgtcgcgcccattcccggtgtaaatccgtacttcatataattacaagaataaaaactctctctgcttaaaatgacgaaatccgagctcagaccgatcgtaaagccagctccgatggcatgcccctgcatgacggaaatcacagggatcctgcaatccaataaaagactgtgaagctttaaatctgtaaattgaagctttccgctctgaatggtcaaaagcccctcctgcgttcctcccgtgcagaaataatttccgtaacccgtcagaaggacagttttataggacggatgggcattgatgtcttggaatacccggtgcagctctcttacaaactcttctgacagcccgtttttcccggccgtatcctgcattgtgacctgcacaatgcccggttctgtttcctgtacatcaatcattggattcatgtgtattctccgtttctttaaaaatactcaagcctttccggctcttatactaggtcgtccattcatactttctgtgaaactcttttatttcagtcagcactaatcgcgtttttccttgatgcgcattcgggatgtctgctgcgggcgcggcatttcttgtgccgaattttacgatgccgctgtcttggagcagccggtcataatcagtcatcgataaacggacgcgtccatccaaatgccggctgatctgaaattgattctgccgcgcacggctttgcggcataacgacaccgctgtaaaattcagagcagcagcccgaaccgtatgaaaaacagccgacgcgtttcggcgtttcaaaagagccgttatcaatcgtgctggcaagagataaaaatacggtggcccccatgatgttgccgacgcgctgacagtattgaatcccaggcagcacgcgttgctgaaaatccgcttcaatgtcctgcggcttagcctttgccaattttctcatcatcgtccgatgcgctccttttaccattccgccaaacggagtatgaaaagaaaggtattgaaatgtattcttataatccgccccgctcacacgctttcggtattcctgaaatgaattttcacagcaatccaaataagacatgagcgacagatcagcatcccccgcttcactatccggaatcgggcggcaggtatccatgacttcatacccgtaatacccgcttgcaccttgatcaagcaaaaagacatgaggagtgctgctgactaaaagcgcgacagctcccgcccccgcactcggttcggcataggaccattcctccgtcaacgcgtcaccgccttcagccactaaaaagcgggaaatatccgttccgatgatgagcgctttcgctcccggcgatgtttgcgacaagatgaaattcacgcccatttgaaacccggccgttaaagaatagcaagcctgcttcacctcaaataaccggcaattccgcttcagctgcaaataatcatggacatatgtactgatggatttgccaaaatcaatcccggattccgtacaggtaatgaccatttcaatctgattccgttcctcttctgacagagaatcgataatcggttttgcggcatttacggcgaacgtaatcggatcttcaaacggaagcgccaccactttttctttcatcagcaggttctcaaacctttttttatccaggttccgatgttccgcaagctccatgacgtctacatacgcggttccgccaaacacgttcattgcttcgattcctacattcatttctccaagcccccagagtaaagaggcttcccgcgaagcctcttttattttttcgttcaaaactcaacaagcagcctgtcaacgccgtgaaatacagggctcggaaccagattcggctcttgatcctcagtaaaacgccatgcgggcatctgttcaaaaaagtgggaaagcgcgattttcgcttcaagccgggccagcggcgctcctaagcaataatggctgccctgaccgaatgacaggtgctgattcggctttcgtcccaagtcaatctgatcggcattttcaaacttcttttcatctctgttcgccgatccaatccacgcatatactttttctccggccggaatcgtttttccgccaatctcgctctcaaccgcggtgtagcgggttacccgctgaatggaaggtctgaggcggatgacttcctcaataaagtcaggaaggagcgccttattttcaagcagccggggcagaatatgcgggaactccttgagactgagaaatgaatttccgatcacattttccgtcgttacgtgccccgcgacgatcaacaagccgcaaaaaccgattaattgcttgtctgacagcggctctccgtctaaatcagctgaaattaaatggctgattaaatcattttgcggctgttttctccgctgtaaaataaactgcataaagtatccgatcatctgcttttgcacttcattcattttcttttcatcttttacattctggctttggtcgacccagcttttaaagatatccctgtctttcggaggaaatcctaaaagctctgcgatcacgataatcggaagcggaaatgcgtaatcttcaataatgtccatcctgccttttgaacggacggcctgaagcaggtcatcagcgatagcggctatacgcggtgcaagagactcaaccgatttcggcatgaacggctgattgaccaattttctgaagacggtgtgttcaggcgggtccattttcaaaaggctgtctttgttaatatgccggatcattttttcctgcttgtccgcacttaagtatttatgatcggaagaaaaatgactgtagtcagaaatcacccgcttcacttcatcataggtgaagatttcccagcaatcttccttttcattgtaatgaacgggagaggtttctctcatcgtttggtaccacttgtacggctgctgctgtctgatttttgttaaactggtcattttcattcctccaagatgtgtccaagatttgaaatgacccgccaaagcttacgagtaaacccggcgggcggatatgtgaatttacggtcttattttggcgggctgcttcagcatctcaccatgcacgttcagtatcttttcctgcagtttcagaaagctgtgttctgtcattccgtctgccgaatataaaacgccgcaaaattcagaaatcgtttcggctgcgctgtcttcagccaataacgtcatatggttggataccgccacatccatgatggcgatgtttgtcatatgctcttgccactggctccagtagttgacgaaatcagcggataaaatatcggccctgatcgtaaaatacggatcaagctcacccaagaaaataccgtttttatttcggaaataatagcatgtcaccccgttcggatccggaagcggcaggagttcgtaatcagtgatttcgtaagcgtcctgaacgtttatattctgcctgatcagatttttcaccaacgcgtccgtcttcgttaacccccgctgtttggcttttgctattaattgctctaaaaatatgtcttcatgaagatcggcatctagttcatcacggtgaatcaaggtttcagaaatgcgttccggatgttgatagatcggtgcaaataaagccatgttcaccgtctgcagcatcatatttttatcaaataattcatcaggaatgtttatttcccgcgcacccgccgagtcaaaggagtcgagcatgacgattgactcaacggtttctccagccagctgcaattgccgggtgacttcataagcgagcatgccccctaatgaatagccgcctacatcgtaaggaccccggggctgcacggtacgtatgagcttaacgtaatattccgccatgtttttaatgccgcggatcggttcccggtctgtcatccatcctcttgcctgaattccgtaaaaaggacgcccggtccgttcggcaacaggctggtacagctccactgcccccagcgcggaatgaaaccagaaaatcggtcttccctttccccccgggttaagacagatcagttcgggcggttcttgatcatctgtctcttctgatatatcgttttgtttcgtatgttcctcatgtacttcatcagtgtctttttgaacggaaccggtcagatacccggctaattttgcgattgtcggatattcatagaccagatttgccgtaatagacgcttgatacgttttattaatagactgaacccattccacaccgataatagaatccagccccatgtcaatgaatgcctcatgctcatcaatatcttccggcttcagaaacaggatgtccgcaaggctttctttaagctctttgcgcaaagtgccgtcagagatgccggcaaggggagtttctgcttccgggatttgcggacgtaccgctgtttcctccgcttcagcatactcgggtttctttatttgccccgctatatattccgcaagctcctcaagcgtcgggtgttcatacaccttattggcagtaatctcagtgtggtacgttttatttactgtttgtatccattcaaccccgataatggagtcaagccccatgtcgatgaaaggctcatcagcatcaatatcttccggcgacaaaaataaaatatctgccaggcttatcctcaattcttcaagcaatgttctattgtcttcggaaacggcgttttccggctgctggacaggaacagtacaatccaaaggctgtaagacgatcggtttttgcaatgtctccggttcaaacgctgtcatttcgatctcagttaaaggactcagagaaatcagaccttcatgttcaggctgtggcggagacgggggaacggtttgcgtttcagactttttcatggcttggcctggtaaagaactgtttacatcagccgcccaatacctttcttttaaaaacggataggcaggaagcggcgttttataatattgccctccgtcaaaaagccgtgtgaaaggaagatcatatcctctgcaaaaaaggtcagcgatatgtgccaggctttctctgtactgtgcgggtgaagccgccgagcagcactgttcaatgcattccattccgaatgttttcattccggcttcgtctgccggcttctggtccttcaaattggacacaaacacacccggaagctctctttttacaagccactccgataatacccgcttcagttcgtccgcactgcttacgatacaggcaaaccggtgatgcagatgctttctgccgagcaggagcgtataacttatatttcccagatcgctgtctttgttcttgctgagtgaatccagcaggcgttctgcctgaatttccagctgacgctccgtccgcgcagataaaggaatgaggcaggccggttttgccggtgaccggcgcacggtttgcggcgcctcttcaataacaagatgggcatttgttccgctgaatccgaatgaactgatcgcggctctgcgcggtgcatccggattccgttcccacggtatcagcttttcattcacaaaaaacgggctgtccgcaaattgaatatgctgattggcttgatgaaaatgcagggaagccggaatctgccgatgcttcagcgacagcaggattttaaacaatccggccatccccgcggccgcagcggcatgtccgagattggttttcacagagccgatggcgcaatatccttttttatccgtatagcggcggaaagcgcgcgttaaggcgctgaattcgatcgggtcgcccagtgcagtgcccgttccgtgagcttccaccatttgaatggtttccggattaatgtgaaaagtatcatagacatgccgttccaatcgttcttgagaaagcgcgcttggagcggttattccgtttgtagcgccgtcctgattcattgcagagccttttatgacgccgtacacatgatctccgtcactgacggcgtcgctaagacgtttcagcaccaccgctcccacgccttcacccggcacgaagccgtccgcgctttgatcaaacgtatggcagcgcccggtcggtgacagcatattcgccttatttgacgactgataaaaagcgggagtggattgaatgaaaaccccgcccgccaccgccatttcggtttctttcgtccagagcccctgacatgccaaatgaatggctgtcagcgaactggaacatgctgtatcaacagtgatcgccggcccttgtaaattaaggtgataggcgatccttgccggagtgacggaattgtgattgccccaaaaagcctgcgcgggcccctgctgtttaaaaatggcctggtaatctccgccgcaggagccggcatacacgccgcattcccggcctcttaccgagtctcccgcatatcccgcatcttcaagcgctttccatgattcttccagaaacagcctctgctgcgggtccatataggttgcttcacgtcccgatatatgaaagaaaacgggatcaaaacattcaatgccctctataaaactgccatactggcattgactgtcagagacagcccatctgtctgcttttttaatcagatcccgtccggcggctaagttttcccaaaactcatggacattctccgattcagcaaaccgcccgctcatcccgataatcgcgatcggttctttttcaggtaacacagctgctgattttaccgtttcggccggatccttttgttcggggcggtacgtcatttgatacggctcagaaacgctgatgacgattttcccgatatttccgcggtcatccagacagtgatacgcttcttttatgtcttcaaaggaaaagatttttgagatgacaggctgaatgactccctcttccgccagccgctgcagttccaattgatagtccttgacctgatccggattttgaagagacagcttccgcaaatccacgctgtgaaacgattgattgttatgaaggacggacaagtcgactgatttagcggatttcagcgcagtcatggcaatttcgatatatcttccgcccggcgccaggcaattcattcctttttgcatggcatcaccggccagggtattaatgacaacatccaccccacggccgccggtcattcgcatgatttccgtttcaaaatcttcttccaaatagcaaatggtattgttgatcccgagcgaatgcagatactcaatttttttctgtgatccggccgttgcatatatttccgcgccgatatgccgggccatttgcaccgcgatcagccccgttcctcccgtcgcggtctgaattaatattttttcgccttttttaagtccggctttccggaaggcgtctatcattgtcactgccacggtaggaagagcgcatgcttcttcaaaggtcagccgggccggtttatgatagacttgatgttctttacatgtgatgagattcgcctgagagccaaattcctctcccataccgacaatcacttcatcacccggaatgacggatgttacatgcctccctgtcttgatcacgacgccgcttgcttcgaatcccggagtgaacggataaggcggcatcgtcggatacagccctctgacacaaagcaagtctccgaagttcaaagaaaaggcgcggacggctatttgaacttcgtcatcttttgtctcgggcacttcactgcgggcaatcgtcagatcttcaatgccgcccggacggtcaatcacaacccggaacattcccgagtcatcggactttgcgaaagaaagcggcatccgttcttgtttcggtttctgataaccgttttcctttctatccgtcttcaaaggtttttcagcaggccgttcttcctgaagcaccgggcggattttcgctctttcggtctccagagatgaggctatgatggtttcatattctgccgagatataaccggtcagcagtttcacatgatagtaatcaaataaaatcgttgtctgcagtgtaagattcaatcgcttattaatctcgttaatcacattgacggccaaaatggaatcaataccgtattcagagaaattcagttcttcctgaatatcctcttctttcatttttaatacatcggcaatacttgttttgatgacagagcggacatgggaagcgaccgattccccatcagccttaacagcttgatgctcctctggcgcgcggctgcgggaaacaggctgtgcgggctttcggaaaacttcggccggggcggcgtatggctttctgccgtctctgatcccttgcatccggacgagtccgtcactctcagctgcgataatctgctgacctaaatcatgagccgtttcagcagggaaacaaaccgctctgtatccttccgaatgcagcacacgctcccacgattttggatataggccgggacttcccggaatccgaagctcagcatcctcataggaccaccagccgtcaagcagcccgaaggttaaatgggtaaaaacagaacgatcgctgatttcgtttatcaaaatcatcccgttgtatttcaggagcgctttcagacggcgcagtgtcaaaccgatattttttgtggcgtgaagcacattggcggcgatgacaatatcgtaaacacccgttttgatattttgtgattcgcaaggctcctccgcattaaacaaggctgttgtcaaatacggcacatcaggtccgtattcctgttcggcatgcattaaaaaagctttagaaacatccgtataacaatattccgcaatctgttttgcaaatggtttcagttttgtaaacagcatggcgctcgttccgcccgtcccggcccctacttctatcagcctgatacgggcatcgggatgttctgtaaggtaggctttcaggtaagcggccgcggaatctgctaacacttcattaaaataatccgcaacgggattatgcttataaacaccttcaacgagccgcattgatgaatcgggaaatacgatatccgtagccggacgttctccttttaaaattgaaggcatcgcttttatcgtcgcctcggccaattcagcttgcgcaagctcccccttgggaagcaggcgtttatgggcattccactcattccagactgtgcggccgtccgggcgctgatccgcgagaagagtgatcgtgtatccgtcatacgcgatatatccgttttcttttaatagattcaggctttcttccagccatctgccgtatgtgccgatcacgccggcgctccgcatggatgctgcaggtgtggtgacaggctcgctgaaaaacccgattgactgtaattgataaaagagcagtttgcaaagaaggctgttcatatgcgcaactccatttctcgttttaaagtctcaagccgttcattccgatccggattttgccgcttgacgctttccataaatgaaggctccgggccggatacaaccgatattgcatcttgatccgtcagtgcggctaagccgtgcggagcagctttgatgaatgccgcttggctgaacggttctgatagtaagacttccagcgcctccattgcttcatcgggttcaatagaaccgatccctgacgcctccatccgttttctgtaagacgggtctgatacaacgcccagactgccccaatatccccaattcatgactttcacttcacaatcaagcaaggaagcgatatggcgggcaaaggcgtcttgaaatgtacaccctgccgcatagttgctttgcccggcattttttgtgaaagaattaacggatgagaaaaacagcacaaaatcaagcggttctcccttaaaagcttcgatcattcggacgctcgtattcaccttagctgaaaaagcgtttctgaaagaagcttcatccatattcgccatacttttgtcggcaagcgttatcgcggaatggatgactcccgttatattgccgtatcgctctcttatggaacggacggccgctttaagcgctgcggcatcttgagcatcagcctgtatataatgcggcgcggggcctgatagggccagcctgtctattttgctctgaatctcctgatccttcggccgcctgccgatccatatcatccgtgctttgtaacgggtgatcatgtatttgctccatgcttctccgatgccgcccgctccgccgatgacagcataaacgccgccttctctgtacgacatacgcggagcggaacttgtcagcacccggactgttttttgcttgtgccaagctccgttacggtacgcggcagcatttccgtccggatctggaggaaggcgccagatgtttttcatctcagacgaatcactgccttcttctgcatcaatcagcctgatgtcccagttcggatattcttttgccaatgaaccgatcaaaccgtgtacgcctgcatgctcaggctgcgggagatcacccggatacacggactgtgtctgccgggtgaccgccgtaaagctgatgtttcggtttccatacccgagtgacagcagcgctttgatgaaacggaaacattgaatcaccccattctcctgctcatcaagcatttcctgactggcggatgcgggtgcgaaacgatccggcgcaatccataagaaatggcggatatcttgataaccggctgtcaattcacgtaatgtttgctcgcttgaatgatccggcgtctccgccagatgggcgcggggccacatttttgccgcggcctttatggtatttcccggctttccgatgatcagcaattgttcctgatcaaccgctcgattttcttccagggaaaagaaagttttgtcccaaacaggggcaagcatcgccgtctgaacttcctgccgtttgctttcggtttggtttgtctgccggacagcccggcaggagaagcccgtcaatctcatacaaacagcgccgttttcatcacataaatcaatatccagcgtcagcgctccgttatctgaccgatcgctctgtttgcggacaagcgcccacatcgttttctgagtcggctgaaatatttctgcctgccgcagggaaaacggcagcatcggagtgtctccggcagtatctgaaccggcccccagtgacgcctgaaacgcggcatccagaagactcggatggatgacaaactgatcggcggtactgtctgccgtttccggcagcgacagccgggctgcagcccccctctctccgatcatcagctgatcaatgccttgatggctcggcccgtagatcatacccgcatgccggaaagcctgataaacctcatcagacgtcataaccgattgactgcagccggacagccagccctctaaatgaacagacggaaccgctgctatctctcccgataccgcagtgcctttactgtataaaatccgttctcccccaggttcttccgataggctgtaaatcgtaaattcaatgtcttcattttccttaagaataaggctgatatggacttctacatccgtccctttatgaatgacaggcctcatccatatgagatctttcaaatacattcctttacgtccgtccggcacagcgtatgcggcacgctcaacggccgctctggccatttcgatcacggcggctcccgggagcaccttctgtccattaactgtgtgatcagtgaaaaagaattcccgtccggtaaaaacagaggtgaatttcagctcccaaagatcggatgtgttttcatggagcagcggatggatcaccgttttgccgtcatccctttttgaaaccgcctcggcttcatcttgaatccagcatctgacttttgcaaacggatagacgggaagactgattctccggggtttttgttccgaatataacaagttccagtccacatcgactccctgcacccacattttcagcaaatgaccgtactttctctttttcagccatttaaccatcgcttcctgcaaatcttcatcagattcaaacacagccactgtctcatgatttcgcttcgcccgtcccctgtaaagatgcggtgcgttttcattttccaagtacgatctgagcttgtcctccagctccttaagggagtccgcaatgagagccagccgctcatccatcgcttcgcgccccgcttgtaaagtgtacgcgacatcaaataagtccggcttatcaatatgcttcttttgaagaaaagcaagaaggcgctccgcatattctgtcagacgctcgccatttttcgcagacagcagaatgaccgccggctcttggctgctgattgcttgtttgacaggagcctcatattcttcaataatgatatgcgcgttagaaccgcccgcaccaaagctgctgattcccgccctgagcggctgttcttctccgtctgctgaaatccgtttccaatctgttaattcacggcagacggaaaacggcccttcatcaaattgaatattcggatttaaaacatcagcatgcaaggatggggcgatttgtttgtgcttcatctgcagcagcacttttgtaactgcggcgatgcctgctgccgattccccatgtccgatatttgatttgacagacccgacaagacatgtttcaggaacatcaccgaatgcatcggttaaagcccggatttcaatcggatcgcctaatttcgtccctgtcccgtgcgcttccacatagctgatccggcccggagatacccccgcttcctgtaaagcttgagaaatgacttcgctttgcgccttggggttcgggacggtgtaaccgctcgctctcccgccgtgattaatggcagctcctttaatgacgccgtaaatccgatctccgtcttgtacggcgtcttctaaacgtttaagaagcagcaccccgaccccttctgccggaatatagccgtcacctccggcgccgaaactcccgcagtgtcctttagatgagatgaactgcccctggctcagcatgaagtacttgttaggatgaacggtgagattcactccgccggcaagcgccgcgcgaatccgatgatcccgcagatcccggcacgccatgtacaatgaagtcagcgaacccgaacacatcgtatcgaccgaaatgctcggcccttgaaagtcacaaaaataggagacacggttagcaatggatgaaatcccgccggggagcccgatatgccgtcctttcactcccgcttcagccgcgaatagcgggtattcctgatacatgacaccggcatacacgcctacctgacgccccagttcaggtgatgtcctcgtatatcccgcatcctccatggccatccaagcatgcattaaaaacagccgctcctggggatcaaggtgttccgcttcccggggggaaatcttaaaaaactcaggatcaaaatcggcgatcccgtcaatgaacccgccccatttgctgtagatcgctcccggcgccgtacggtcctcggaaaagtaatgttcccatttccagcgatctttcggaatttcggtaatacaatccttgccttgtttgagattatcccaaaacgcatcgatatcatcggcctgcggatacttgccggaaatcccgacaatggcaatatccagcggttttcctttcgtttcctgacggctttgattcccggacggggcaaaagacgcattttcaagccgatttggctgaagcacttctttcacagacgcatttttcaattccgccagctgttccccggtatgactgaggattgcggcatcaaatgagagaaacccgtcttttttatgtttgattgtattcaccacatagacggtatcagacatgacaggtccgtaaagcgtcagcctctcaatcatgagcgggacgtgaatccgctttttcagctgcaattcttcttcaccgagcgacatataacatgaattcaatataagcgggtcaaatgcaaagtgatgcagatcgcctttttctttttttcctgataagtccagctgcaataaaaaggagctctcactcattttgtatcccgctgttaccgttttcagcatcgggcctatcgtgaagtcggcaaccgaatcgtacagacgggaaatgacatccggcgccaccttttgtgcatgcgacttcatttgctcaacgtcatatgatttttttatgggtgcctctgtatatctgcttatttctccttccgcacatgtcttccggctttctttaccggagacagtgcagcttgctgtaaagcgttcggcactcttttctgccgcaaatgaaatgtcaatctgcgcggcctctccaggctccagcgtgacgggcccgcccgtaaagcggatatctttcagctcggcgggacacgtgccggaatgagacgctccggatgcttcaagcaccagacacggatacactacacccatcagtgccggtttgccgaaaaccagatgatcctgaaggaatgcttcatgttcatagaaagtaaatgtctgactgcctgattgtgtttcagagaccggtgctgcatctgcgacaaggctggaagattcatctgttccttttgtttttatgtcttcgagcagttcggatatgctgctgcactcaaataaaagagtcggattcagacgcagatcaaacgccccttcgatgtctttaataatagccagaagctgtgacgattcaagacctaattcaaaaaacacggtgtgcgcatcatttcttgtgactgaacggcctacgtatgtcgagaaaatgcggtataaggtttcctccatctgctgaacgcctggtatcagctgccggtcaaaccgcacctttttggctgtcaggccgagcagtgaagcaatatgcgcaccgctgaggttgtaaaagtcaatatccattttcaccatttcagaaggcgtgccggactttttcgaaatcaccgcgtaacagcgctccgtaacagtctcagcggcaataaacgactcataataaatcggtaaaaataactcggcgcctgcagctgtctgcaatacgccggaggccatggcggcaccgtccatcagcgcgggatgaaagagagcgccggggagattttcccggcatgaatcagactgccgaatatcaaggaaacatgcctcttcataagcatagatctctccctccggcttcatcagcccgtcatgcgacagtccgcggcttctcgcggcttcgtaaaccgcatgcaaggagactgatggaagtgcggcttgttgttttttctcccctgcgtcaagacgcctgtctgatgagaagacttcttcatgcatctccgctgataagaaaaccgtcccggaatccgcctcgcaaatcgaggcagtccagaactccttttctttactgaatatgacactcacatcaagccgctctgaccgcttcactgataaaggatgataaatggtcacccgtttcagacagatggaacggaatgaaagatcaaggctttgctttgccagctgatacagcatatcaatataggccagaccgggcatgacagattctccgtgaacaagatggtttttcataatgggatgctctgccgtcaggcgcagattcactgtttttttcatggttagtccccttttaaaaacgtcacgttgtcacctgccaaaacgagtctgcaggtgcagtgcttgtctctgcttttttctcatatttctttaaaagatccgcaatgtccgttttttcattacttgttttttccggttcactttccgtgctgttccagccgcccaagagcgggtagtgtttttttctgaattccggcggctgaggcgaccggtgatgttcccgctgtctttcacctctgtattcttcaacgaggatatgagcatttgtcccgccgtcaggaaatgaactctgagctgcgacgcggggtttcttctctgaatgccaatcaacgggttcacgattaaaatgaatacgcgacgcttcaaagtcataatgttcaaatgggtcacgcgctgataagaaaggcggaatccgcttatgatagacgctcagcacacatcggatgaagcccgcaagacctgaagacagaagcaaatgccctacattcggtttcaccgatccgatccggcagggcagaagcgttttccggttcagctgatagacatctgagagcgccttgatttccaccgaatcaacgattggggaaccgcctccgttcacttctatatatccgatgtcttcaggcgacttttccgccatattaagcgcagtttgaatgacatctctctgcgctcttatattcggtgaaccgggaccgagcgtccggccgtcattgtttaccgagacggcttttatgacgccgtaaatgcggtctccgtcccgcaccgcatcgctcaatcgcttgataaaaaccgcccccgctccttctccgagcacttctcccgctgattcacggtcgaatatatgaaacacgccgttctcatttaaaatatggcgcgctccgaataaccggtgcgcggacggagataagagcagactcaccgaaccgactaaggccgcgtcaatccttccggccaaaagggcgtcttttgcaaaggacagcccgatcagccctgaggaacatgctgtatccacgacaaggctcggccctgtgacattcaaaaatcgtgaaatgttggccgccaaatagttttgccccgcccccaaaatcgggttaggcgcctgcaggatatgttccataccggctgaaggctgcgccctgccgccgatgtacacgccgactttccggcccgacaaatccttttggccgtacccggcatcataaacggaatgaaccgcttcttctaatatgatccgcgcctgcgggtccataattgccgcgtctttttcagagatgccgaaaaagcccgcatcaaacatgtcgatatcatcaatccaccccgcataatcctttgcatttgctgttgcatgccagcgcgatgcggggacaggccggatggcagtattccctttcatcagcagctcccaaaaagcatccgttccgcccgcccccggaaaacggcaggagatgccgacgacggcaatatcgtcttcggtatccgctttcggcttcatggatgttctctcttcagcggcggcggttacatcaggctgaacgtccccgtcttgaacgaaaccattttcttttgtcacaaaatcggcttcatgatgcgctgcgaaatagtcaaccatttctgtaatcgtttgatattgaagcattaaggacggtgttaacttgatgctgatccgtttttgcaatgattgaaccaattccgcaaagagtattgagtcaatcccgtattcatcaaacggcatatcatcttttatctgctcatccgtcattttcagttcttcgctgaaaacggtgcgcacccattgacgaatcatatccttcaccttttggtcaccggcactgctttttttcatgggagcttcagttttcttcaccttcagaagatcaccaaaatcagccttactgtcttcgggaacacaaggaattccgcagctttgtccgtttaatatgatgtaatctaaaaacttcagtccgtcttcggcagacagcctggaaagtcctgatttttgataagcaggtgtttccggcaggccttcagccatgccggtttctttccagacgggccattgaacggctttaacaaacacgtttcctttgcctgcctgatgatttgcaaaagagtccataaatgaattagccatcgcgtagtcactttgccccgcagcaagcgaagggatcagacccgaaacggatgagaacaaaataaaaaacgacagcggctcattccgaacggcttcatagagaccgccaagccctgttactttcggcgtgcaaacgctttcgatctcagtttcggttttgttataaaaagcggggtgttctcccattgcacccgcgcaatgaaaaacaccggtaatcggtcccattgtgccgcggatgctgtccgtcatgttccggagccccttttgatccgtaagagaaacgctgtaataacggatctccgcgccccgctcggctaacctctgcatccgctcggctttttccgggagaatgccgtcctttttcatgtcttcccactccgaggaatcgggaagcggctcccgccccatgatgaccagttttctgcacccgcgtgaaacggcatgctccgccgcaattgcgccgatcccgcgcgatccgcccgttattaacagcacatcatcagacgaataggaaagctcaggcaccgcagacacattcgtacccggcttcagaaacggcacataacggcgattcagcctgtagcagcattcactgccgcttttggcccgcggctgtaaaaattcagtttcaatctgtctgcttaattcttctgtatgctcaatcgcacaatcgctatctatcgtaaaagaatgaatgttggcatactcagcgcccagcatccggtacagccccgccgttttcgccccctgcatcagaggtttactttccttgaaaggctggaggcggtgtgtcacttggctgagcacagcgccgctatgacggaatgattccagaacctgctgtaaaaaggcaagctttccgtattctatctcttcccgccgttcatattccgcatcatatgcggttatgtcgacgaccccgagtatctgtttgttttgaagagactcccgcactctgccgtaaaggtttcgccccgatgcggcagcgtaataatcggcgccgtcttttgcctgatggatgaaacagatcgtttcaatatggccgtttcctttaaatagagcatcggccaatcggctcgtcttatcagttgcaagtatcattactgttcctgataatgcttcagactccgccggatcttgctgcttccagtctttttgaagaatgatcttttggttttccgccggttcgtctgtctgtttccggatatccgcaggcacaggcacccaataccgctccttcgcgaacggatatacaggaaggctgacccgtttcggcttctctccttcgtataactggctccagtcaacggcggctccttttgcccactccgtgagcaatctggaatattgcttgtttttcaaaagctcggccattccacttgttgaaataacatcttgagcacgtccgcggaaacacccttcaatttccgttttccgttcaagcacatccttcagtttcgcttgcaggccgcaaacggatgtaacgatcaatgccagccgttcaggcatcgcttctctgcccgcttgaagcgtgtaggccaggtctttaagattgacttctttttcccgtaaaaagcggtcataccgtttgacatattccaatagccgttcttcattttttgccgaaagcagaaacagaaccggctcgtcttcccgtatactcagcgatttcttttcagcctgcggcggcagatattcttctatgacaaaatgggcattgctcccgctggcgccaaaagaacttaaacccgctcttctcggctggtcaggatgtgacggccgttcccattcttccagccggtccgccacataaaacggcgtatccggaaatggaatatggggattcagcgtgtccgcgtgcaatgacggaaagatttctccatgcttcagctgcaaaagcacctttgttaatccggcgattccggcggctccttctaaatggccgatatttgatttggcagagccgatggcgcaaaaccgctttttgtttgtccatttgcggaaagcgcggctcagcccttcaatttcaatcggatcacccagagacgtacccgttccgtgagcttcaatatagctcaatgtctccggatcaatgccggcactctgaaaggaatctgtaatgacttccgcctgtgatgccggatcaggcacggtcaaaccggatgtttttccgacatggtttaaagcggagccttttatgacgccatatatcggacagcccatcttttccgcttcttgaacggttgtcagcaacaccgcgccgacgccttctcccggcacatagccgtcaccgccgtcggcgaagcttttgcagacgccttctgaagacagaaatccggcattcgccaaaaacgcatatttatgcggatgtgtgaccgcattaacaccgccggcaatggcgaattcgcactccccccttttaatgctttcacatgccaaatgtatggatgtgagcgaagaagagcacatcgtatcaacagccattgacggccctgtaaagttcaggcagtgagacacgatattcggaacggaggcaggcgtcacgcccatagacagcggtgtgccccgctgtgtgatttcagcgccgaacagctcataatggctccaaaacacacctgcgaataccccgacgcgttttcttttttgtgaagatggcccgcgcgccgttctgtcctgataaaaaccggcatcttcacaagcttcccaagccgtctctaaaaacagccgcgcctgcgggtccatcatttcagcctggcgcggagtcagattgaaaaacagcggatcaaagctgtctatgcgatctaaaaatcctccgtaacagtagaactgatctgcttcatatgagaaaggataacctttccatctgtctttcggcattgttgtgatacagtctttacctgagcgcagattttggtaaaattcatcgatgcttcccgcctgcggatatcttcccgccaatccgattacggcaatatcgtgctcttctgtatgtctctcttgttttcggctccttctcttgacagctgcatgggataatgaagagcggttcttgtctgccatcggaaccaatcgggccatgctttcagttacagcaggctccttcccgtataaaataacggattgcagcttgccgagacgcagcatatattctagtgaagccatcccttccccggccggaagcgggctggtgccggttgcatcattcatgatctctttcatcaaactgtcaacctgcatgccgccatcttcccaaagcggccagttgatcgtcatagaagccccggtccgttcgcctttttccgctttgcaatcgcgatatttcatatattcatccataaaagcgttcgctgcggcataatctgtctggcccgcatttccggtcaacgccgagaatgaggaaaatgcggcgaaaaattcaagcggttcatgccgtgaagcttcgtccgcatgaatcaggccgctgattttcggcaggaacaccctcttcaagtcagtactgtctttttggatgataaattgatcttttaaaacaccggcgcaatgaaaaatgcccgtcagacggccgaaagtttctgtaatctgagcaaatgcccgctctgtttcggctttgctgccgatgtccgcttgaacgtaaagaacttccgctcccaatgctttcagtctgctgatcttctcagactgttccggcgaacgcccgatgagtgcgagcttcaccttttctttttctgcaaggtgacgggcaagcagaaatccaagaccgccgagacctcctgtaatgacatatacgccgttttgtttccaaggagactgtgtctgtccgcccggtttctcaatacgttcgaacaatctgatctgccgcatatcgtctttataccgaatgtctgtgcagcctgcatgagagcagtctgcttctgttctaatgattgcggccgtctcacttggcaatctctcattcttgtcacagaaggtgatcacctgagtgcgaagagccggattttccagatgtgccgttttcagcatagccccgagagcggaagacaatgccgctccattctcaacggcgcatacaagctgaatcaatgtatgttctttcggatggtctgtcagttcccgtttaagcatacgaaatataagctcggcatctgctccaaactgctcatctgcaacctcatgctcccttttcagttctatcacttccgcttccgggcaatgtgtgccgagttcaccggtgagacggggtcctgcatcggcagcaataataagatgacgggtgtgtttttgcccgttctgcaccgccgtttccagcggatgatctttccaggcgggttcaaaaaacagaacctcatcagcgatgtcagcgtctgatgtatgccgttcttcggccgaatctttcagcacacagcccgcttcattgataaggtaatccgcaaggcggcggacagatgaatattcaaaaagcagtgtcggataaaactgctgctgaaaagtctgctctaatatctttacaagcttcagcaaatgcgccgagtcaagccccatatcataaaagcctttccgcacatcaatatcctgtgccggacgattgatcagcctggcgatttccgactttatgtaagtcaccatgttttgttccggcgtttgctgttcagacacgtcttctgcggccacaggactttcgggctctccacggccgtttttgttctgctgaggcggcttctctttgtctatcagatgggtaatcatattcgcttgtctgaccctttttactgtcagtttctcacattcggccaatacgttcccttccctgtcgtaaatcgtgaagtcggccgaataaaaatcaggttcgctatctgatgcgccgctttcagtgcggctgttttccgcagaataagtgtaaatcgttttcggaaacggctgatatatgcaaaaacgattaatcataaaaggaatatacggtgtgtcattctgcttttgggccgacaatgcaaaggaagagccggcaagggtggacgcatctaaaaaagccggatgcgccttgaatttctcccggaatccttcagccaaatcactcagagtgagctccattaattcttctttatcctgaagctgataaacggccccttcatttttcataaactcgccatgctcaatatggcttcttcttgcaattccgtaaatgtcatgcatgtcccattttcggcttgcgtttttcatgaatgcttcaatattcagctcttttgcccggggcgtgtctttttgcaaataaagctgacattccatattctcatcccgttttccgccaagcggtgtgccgttttttgctttttcgcttgtaatctcaactttccagctgtcacgcgccggcgtaaaggtgacatacaggtgtttatcaaactcttcagatgttacaacaggctgcttaaaaataatctgtcttaattctataggcctttcaccgagatacccggcggcgagccgatacagcatatctattaaagtcacgcccgggaggacgcggatttggtgaacgcgatgatcccggacgatataattcgtatggctgattttctgcaggaacgttttgacttgatcggtggcaactgccaatctatcacacctcgcttatttcaaacattgcttctgtgcccgcctcattttcttccgcttcggacaactgtgctttttcaggccaataccgctgttttcggtatactgtctggccgcctttcggttccatggtcgcttttcgttctttcggaattccttcgttgctgacaatgatatgggcgttattcccgcccaaaccgaacgcgctgaccccggccctgagtatctctttttttccgtcccaccgcttcagctcaagcacaggataaagcggcgaatcatgaaattgaaagcgggggttcggtttatggcaatgcaaagtcggcggcagttcttcattggcaatcgccagcaaaactttgatgattcccgccgcgcccgccgcactcagcaagtggccgatattgcttttgacgctccctacaccgcaaaattgtttttcatcggaataagcagacaagacattggttaatccttttaattcaatcgggtcgccgatcaaagtaccggttccgtgcgtctctacgtatgtcatggtgtccggctcgatttccgctgattgaaccgcctgctcaatcaagtcctgctgcgcccggggattcggcgtagtcacccccattgtgctgccgtcattatttatcgcagagccgtcaataacgccgtatattttatcttcgtcttctatcgctttttcgagcggcttcagcatcagcacaccgcagccctctccgattcctgttccgtccgcatcggcatcgaaagattttgaacggccatttggcgataagattctcgccgcgctcattgtgagaaaaggtttttcatcaagcaaaatgtcaaccccgcccgcaaaggccgcctccgcttctccattttgaatagcctgcacggccaaatgaattgccgtaagcgaactggagcaggccgtatctacgaccaggttgggccctgtaaagttataaatgtgcgccatatgtgcggtaataaaattttgccccgcgccaataatcgcgtctttttgcaaatattgaaatttctgatgaaacgcacctgcccttgcaccggcaaaaacgccgatacggcggccccagagatcctctttttgataaccggcatcggccaaagcttccgcgctcacttcgagccactgcctttgcagcgggtctatcatcggtgccagcgtttctgaaatattaaaatactccgggtcaaattgatcaatatcatgaataaaaccgccccatttactgatgctttttccttcttgatattcacccggctgatagtgttccccggcgttccatctgtccggcggaacttcagtgacggcatccgttccgctgcggagattcttccaaaattcttttatatcccccgcttccggaaaatgacaggccatgccgatgatcgcaacctttccccgtttcccgggcttatctgccgtttttttgctctgtttcggcgttttctgcaaagggaccttctccgcgggaaccgctgcatctgccgaaaaagcttccggacaatgtgcggctaaataatccgcgagctgttctatggtagggtgttccagaaggacagtcggatcaattgaaacggacggcagtttttgatcgatctttgtcagcacttgcgccagaaagatagaatccattccgtattcctgaaaaggcacatcgatatccatatgcgtttcatcgatactcagctcttttgccaaaagcgacttcagccaagattgaatatcagtccggttatggacccgtttttttgtttcaggaggtttggaagctgttctcattcctttatgggcggctggcttggcgttttcaagcgctttgatgtcccaatcatttttcacttgtgccggcagcacgacagttccgggtctttctcttaaaatgtaatcaagcatcttgagaccttccgcgtcagagtgacgcagcaatcccgtttgctgatacatcccgctttttgtatccctgctcatgcccgtctcatcccatgccggccattgtatgctcatgatgccgccctcattgttttctgcaaaatagtccatataagaattagccatcgcataatcgctctgtcccgccgcaagaatcgggacggctgccgagacagatgaaaacaggacgaaaaatgccggcgcatcatcctttacactctcatacagaccgcggaggccgtctgctttcggtgcgagcacccgcgcgatactgtctttggatttgcggagaaaagcagggttttcacggtccgcaattcctgcgcaatgcagaatgcctccgacaggtccgagcgttgtggttacctcttttataagccgtccgacggcctgcttatccgtcagatcaactgctgagacgcacacttttacgccctgtgattccagctttcggataagctgtattttttccgaaacgacagggtctgtttgctcaagatcccactctgttttcggcggcagctcctttctgcctgtcagaagcagtttcttcacaccgtatgcggaaacgaaatgcttggcgcataaagcgccgagtccgcgcgttcctccggttatcatgaggacggcgtcttttggaaacacagtccggtctgtttgcacggcttctggttcaatctgatcagtctgccgaagaacatagctgaagcgcatgccgtccctgtagcaaacagcagattccgttaagtctgattcaatttcttgtttaataaaagcggctgtctgctccagcggctcttcaggatcaatatcggcgtgacaggtgagaatatggctgtattcatgccgcagcatgcgataaagccccgctttttcaataccatgcatagcggccgcattatttttgaaggattcaaggccttttgtaagataaagcattttcatgttttcttttccgcggccgtattcaatcagctgctgcagcgatgccacccagctgatgtcctgccgcttttgtcgggagccgcagccggtgaagtcaataaacccggaatagatggccgcattcgcatcctgtaagaaagagatgagctgattttcctgcacaatgtcagcatcattcagctgttttttcacctcggcggcaaggtcttttgtatcctcggagacgatgagcgctattttgctgaatggctcggatgaagacactgcctcgcaaggctcccatgttttctgcaatactactgttttttgattcgaaagcggcagctgctcccgtttcggcacccaatagcggtctgctctgaacggataggagggcaggctgatgcggcgaggcttactgtccgtatacagctgctcccaatctgtgtcaaatccgtttacccagagccgcagcactttcttgtatttctttttctcaatccaggcgctgacgaggtcagctgcgtcttcatcgtctgagaacatggagatcgtgttattctcgcgttttttacggccgctgatgatatcttcgctgttttttcccgtcagaaacgcgttcagtttttcagtcagttcctctgcggagcctgcaatgattcccagcctcgcttccattgcgtcccgtccggtctgcagtgtgtatgcaacatctgcaagatcgatatggcgggatgatccgttttggataaaatcgcgaaggagacgcgctctttctttcagccgctcttcatttttagccgacaaaacaaaaagagatgacgctttctcacgggtttccggctgttccgtctcacttttgcccatgtattcttcaataacgatatgcgcattgacgcctccgaaaccgaatgagcttacacccgcccggcggggcaggacccggccgttttcatcacgcagcgcttcccactcctttgtttctgtcacaatgtaaaacgggctgtccttcaatttgatatggggattgatgttctcgcaatgcagacttttggcgagcgtccgatgtttcagctgcatcaatactttgataacgcccgcaatgcctgctgcgagctccaaatgtccgatatttgtcttcactgagccaatcccgcaatatccgcccggagccccgtctgtttggaaagcttttttcaatgcattgatttcaatcggatctccgagcgccgtacctgttccgtgcgcttctatataagtgatcgttgacggctgaataccggctttttgataagcgcttttcagcacatccgtctgagcctgcgggttcggcgcggtaagtgacgctgagcgtccgccgtgattttccgctgtaccgcggatgaggccgtagatgtgatccctgtcatgctcagcctctgaaagctttttcaagacaatcatgccggcaccctctcctctgacataaccgtcagcctgatcagaaaatgttttgcagcgcccgtcttcactgagcatgcctgctttttgaaaaccgatatgcccttctggcgtgacgatcgtgttgacgcctcctgcgaccgccatatcacaatctcccgtttcaatggcttttaccgcgcggtgaatggcgactaaagagcttgaacaagcggtttctatcggctcgctcggcccgtggatatcaagaaaataactcattcggttcggcccgacggacggcacgattccggtcatcgtatacccctcgacaggaagacccgccttattgattaaggtttgatatccgcttcccaatgtgccggtgaaaatgccggtttttgttccggcaatccgttttgccgagtaccccgcgtcttcaatggctttccacacatacatcattaataggcgctgctgaggatccatcatttcagcttctttcggagatatcccgaaaaacagcgggtcaaacccggcgattccatctataaaaccgccccatttaattgacgttttatttgcatccgctgccggatcgccgtaatattcgcgccaattccagcgatcccggggaatttctgtgatgcaatgctctccttttgataaacgtgtccagaattcatctatgtctttcgcttgcggaaaaataccgctgattccgataatggctatcggttcggttttttcttctgattttccttttacggatacgggcgtttcccgtttgacatgaacggccgccggagcttcagcttttcttattccggcttttggggcggttttaaaattctctctttctaagccgctgaatgcttctttccattcagatatcaaatggccgctcagtttgcgcaatgtcggaaattcaaagaagatagtcgggctgagctcaagctgataagaccgatttaatagatttgtaaattcagtgaagatgatcgaatcaaatccgtattccgtcagttcgctgtcagcctcaatatctttcatgcttacctttaaaagatctgatacatgacgctttagtttctcttgaacccgatctttcagatctcctgcatctgtctctgccggagcttttgcggcggcgctttgttcttcacgcagatcgaaaacatggctgcgaatccgtttttcatctccttctgccaccatgatctggtgttctccggaggcaaaagcggcgtaaagcgcctggatgcctgaagccgatcgcatggctttcattccggtctgttcatacatcagccgttcggtctctttgtccacgcgcataccgccctcttcccaaagcggccagttgacggacagggtctgcccgctccgcttgttgtcccgcacgagacgatttcggcgggctgcatatacgtccataaatgcgttggctgccgcataaccggcctgccccgggtttcccatacctcccgccaaggaagaaaacagaatgaaaaagtccagccgcgcatctttcgctgcttcatcaagattgataagccctttcaccttcggcgccatgacggtcttccgttcgttttctgtctggttcagaatgtaattgtcggcgatcacgccggcgccgtgaatgatcccgtcgagtgttccgtgctcctcctgtatgccgcggacgagggcgatgaccgccgccctgtctgtcacatcaaccggttgatacagtacgcgggcacccgacgcttccaagcgccgtaagcgggcggagcggtctttatcaagcgcttccgcccttcccgttaatatgaggacggcgtttttgacgcgggaggctatttcttcagcgaaaatcagcccgatgccgcccgctcccccggtgaggaggtaaaccccttcgtctttccacggaacggcgccgctttgaagcgcaggcaggtgacgccagtttctgacgagacgtttgccggcttcataacggatttccgcttgttcagggtgcgtccggttttctttcagcttggcaagaagcgatgatgctggctcgtccggatcggcttggatgacttggccgtacagcttcggatgttcaaggtgagccgttttcaggaaagcggccagccccgccaatacattgtcttcccccctgtcggggacaagaagctggatcagcgtttttcccttctgtttttctttgataagacgcttgacgatcgctgacagctccgccgcgcaggcgtcataacggtcttcaatcggaccttccccgtcagccgcacatacggcgccgtttatgtcctcagcgttcattccgccatacagcgtcacgtatctgaaagactctgcttgtccgccgccttcacccggcggtgattcctgccactttggctgaagcaagagcggttttccctccgtttcctcttccagaaaacgggcggtgagccccgtcaatcggacgcatacctcgccgttttcatcacacagctcaatatgataggcgccgtccgctgaggaaagcaccgcccacatcgtctcccggcacgcagaaaacacctgcatatcccggagggcaaacggcagaaacggccgtccggacgcggaaccgtctgagagcacgagaccgatagaagcctgaagggcggcgtccagcatgctcgggtgcaggaagaacggctccttttcttcgcgggcggacggcggaagagtgagcttcgcgagcacttctccgcttccggcatagacggcgtcaagcgcctgatgagacggtccgtaggtgatgccgaggctgtcgaatgcttcataacactcagcctttgacatgtgccggccgccgcagcgcgcctgaaccgcctccacatcgagtaccggagcacgctccgtctcttcgagcacggcctttccctggaaaaagacaagcggctcttctccttcggcatacgcttcaaaagcgatgtctccgttttcttccggctgaagttttacatgaagcgtcacgccttcagaaagcgccgtcaccggacggagccaaacgatctgtttgagccggacacccgcttttccgcccggcaagccctcagcggcaagtgtaacggcggcccgggccatttctaaagcagccgcgcccggaagcaccggttttccattgacgatgtgatcggcaaaaaacggttcacgccctgaaaaaacagaagtaaagcgctgggcggtaaaggtcgatgtattcgcatggagcagcgggtgaagcttttcacgttcagctgaattccggctttcaagctctccctgaagacgatcggacgcccaatacgtctgcctggcaaacgggtagcccggcagattgccgattcgcggcaaaggtccgccataaagcaagtccccttcaatttcataaccttgacaataaaaatctgccagcacgcataacagttcctgatattttctatggtcagaatatgaagcgctgcacttgccgagcacttctattatgtgctcctgaatatgctgtcggcctgcaaagtgctgcggtacttttcccgaaaacacataaggatgatgttcattaagctttgcctgcttccatacatacactgcgtcatcagcatcttgaaccacgatggcggcgcgatggttaaagtgatgccgtccttttagcaacgtatagctgagctgggctagatcattttctttcagtccgccattttccgcccaagtgatcatatcttcgattttttcctgaagggcctcctttgtttttgctgataaagtcagtaaataagcaggggcatccggatgaggtgaagcgctgcgcttatagctttccataacgacatgggcgtttgttccgctcatcccgaatgcgctgactgcccccattcggtttttacccggcagagaaggccacgctttagccgttttattcacataaaaaggacttttctcccagttgatatagcggttttccccgctgcaatgcagactggcgggaatcatttcacgggagaatgcctgtaaaagactgatcaaactgacaatgcctgacgcggcaaacgtgtggccgatattggttttaattgatgtgagcgcgcaaaatgcttcttcgtttgtataggcagaaaatgcgtcataaagcgcgttaatttccaccggatcaccgagttttgtacccgtgccgtgtgtgacgatatattcgatatcttcagggttgatacggccccggtcataaacggaagtaagcagccgggtctgcgcgacgccgctaggagcggtaattccgtttgttttcccgtcataattgatgccgctcgcccgaatcaccccgtaaatcggatcgccatcttcttccgcctctctcagcggcttaagaacaaccgccgcagccgcttccccgggaaccaggccgtcagcccttttatcaaacgcgaagcatttcccgttttccgacagcattccggctttatctatcgtttcaaaaaagtccggggtattcatgatattcaccccggccgcaacagctgttgtacactctttattctgcaggcttaataccgcctgatggacagaaacgagccccgaagaacatgctgtatttatcgccatcacaggacctgataaattcaagtgataagccagccgcgccgccaaaataccgttatgatgagacgtgacattgcctttgtcccgtgttaaaaggtgataatctccttcttccgcacccacaaacataccgatcgtctgctgcctgatgtgactggcgccgtagccggcatcctcaagggcccgccacgcttcctgaagtagcagccgctgcttcggatccatcgtttcagcttccctcggcgatatttcaaaaaataaagggtcgaattcgtccgcccccggtacagcgccgagtttccattttgaacttgtgaagcctttttttgcgaccggtgcgacaacgtccttttcctgaaacagaatgtcccacagctcgtccgccgtgcgcgcctgaggaaagcggccgctcatgccgataatggcaatggaatcagctgcctgactgccctcggttccggcgttcagcttatttcttcccctctgcttctttcgcttttccgttcctgccttttcaaagacagattgatctgcggattcaggtttcttttcttcatagacatgctctatgacggacttgtgttccgtcagaaaatagcggacgaccttctccagtgtggaatgtccgaaaaacagggccggggtcacttcaattccgtagtgagcggacaaagaagaggcgaattccgccaaactgatagaatcaaagccgaaatcagccagattgtcagcatccgtcagtctgttcttgtctattttcaaaagccccgccgccagttccttcacatcccagcttacgcattcttccagtgtaaagcctttcatttcactccgccttcctgaaaacgggacgttcctatttacagaacccgaaatcggccgttcgccttgatctatctgcaggaagcgtttggccctcgacggaaaaccggccaggacgagatactggctggacggctggactaacaatgtttcaaaagcttcgagtccttcctttgtatataaataacgctgtccgcttgattttaaatacatatcggtgctttccgccgtgccgacatgcatccccccttctttccaaagcggccaattgattgcaagtgacttgccgcttctgagtccgaggctcacaagtttatcccggtggcggataaaagccatttggaagcggttccccattgcgtagtcacaagaaccgaagtctcctaaaatcgctgaagaagaagagaaacaacagaagaagtcaagcggctcccgtgacagaacctgatctaacaccgctgtgccgtccgtttttggcgataagacttgctgaaaggtttgcagatctttctccagaatgctttcagtgccttgaagacctgcagcgtgaatgacaccgtgaatcggcccgcatcctttctctttcgcttcttgcaaacctttctccatctgagcctgatctgcggcatccgcctgcacgtaaaacaccttggcgcctgattcttccaatctctttatcttgtgcagcaccgggccgcctgccgctgatctccccgtcaaaatgagcgtaaccggtcctttttcagcaaaatatccggcaaataacaagcccaaacctccgcatccgccggtaatcaagtacgtttttccgctttttatcacacgcctctcaacaggggcaatatccgtctgcttcatttccatgacgtgacggatttccccactgtacatgacactgcggaacgacccgctgtgaagctcttcacatacattatggatcagcttttcaaacggtcctctttgtccaaaataaaccgcggccgtatccgtctccggcaggatcagtttcagcgaccgttccagcccgatccatgactcggcgtaactgatatcggtttcggtcccgcactgagcggaaagaaggatccgcctcggtttagaacgcaaagaagcagctgcgcggatcacatgatacagaatggaatagtctttcacggccttttcatcttcaagcggccatccatacaaaacggcatccgccttgcctgcagccgtttcaatatgccgaaacgtttcttgatatgcttgtccgtcagtgattttaatttgataatgcgtgtttgaaagcttttgagtttcctcaccctgtgaaataaaaaacacgccggctcccggataaagggattgtaaagaccgataagcatgttttctggcagcttctcccgtaagaaaacagatgaccgttttcagctcttcatgaatggatttcttcagaggctgctgcgtccacctttcttcaaatatcatcatctcggagtgttcctcttgcccgtgatcctgctgagacggctgtctcattctcacccctttgatttctgcgcatacaatgccggtttcgtcacaaaattgaatgtcacagccggtttgattctttttattcatatacatccacatgccggatgaacacggacgcatgacgcgcagttcttcaaccgtttcaggcacgatatggactgacggctccgtttttgccaagacatgaaaagctgcgtccagaaattccggcggtagatgatatcccggattacggccgctttcatctgtaagagcaagcttcgcccaaatcgcattttctcccgtataaagcttttcaacggtgcggaactccttactgatcgttacacctgatgtgcctggtgtttcataatcgaatgacagcgggcgacagtctttttgtaaggaggcaatatcaagcatgcgggatggctgtacgttcccttgaccgatgattccataatgatgcagcttctcttcatcactgtatatttcataatggatgccttcctcgtcttcagacagaagggagagattgacgcccgcaccgtgatgtccgccggtaatcgggtcagtccatgccgccgttcggatccatatctctttttcttcagagctgtctgccgcatgatgataagccgcaagcgccatttctaaataaacggctgccgacagaacccgctctcctctcacatcctggaaaacgtgttcccggcctgtaaaagatgtatgatagctttgctccgccaaggttgacgtattttcatgcaggaaaggatgcacatattcagttgttcctgtttttggttcttcccgcttcatccagtagctttcttttgcaaatggataagacggcagactgatacgatgcggcagcgcgcctttatataaagatgcccaatcgacgggcgccccgtggacccaggcattcaaaagactgccaaattgacgtttttccatccaatcaccgactgtgccttccgtctctgtgacagcactatcactccggcccgtaaacaccccgcttacggaatcggcattattcagaaaagcagtcagcttctgttccaattcagaaacagagtccgctgtcatcgccagccgttcttccatctgaaccctgccgacttgaagggtaaatgccgcgtcaagcagatttgcatctgtaattgttccgtttccggcggcatccgacagcaacagagcccgctcgcgcaagcggtctttatcttttgccgataaaacaaaaagcgccggacggccggagtccgccgaagtcatttcagccggttcatactcttctatcagcagatgggcatttgccccgcccgctccgaaagaagatgtacccgcgattctcggatattcccgtgttactccttcagattctatgaccggccgtctccattccgccgtttcctgctgcacgataaaaggagaagtttcaaaatcaatttccgggttcagctgctttgaatgcagcgacggcaccagatatccgtgtttcatctgaagaagaattttggtgacggcagcaatgcccgccgcactttccaggtgtccgatattggatttaacagaaccgatggaacaaaattgctttgcatccgtatagcggcggaaagccttggttaaccccgcgacttcaatcggatctcccaaggaagtgccggtgccgtgggcttccagatagctgatcgctctcgggtcaattcctgcccgctccatcgcgtctgcgatcacttccccttgtgcattcggattcggaacggtgaacccgttcgttttgccgccggcgttcagagcgcttcctttaatgacaccgtatatatgatcatgatcttcaacagccttcttcaacggctttaacacgatacagccgacgccctctccgtcaacaaacccgtcagccttatcaccgaacgctttgcacgcgtttgacggcgacagcattctcatagaagacagtccgatataatgaaccggatctgtaatcaggtttacgccgccggcaatcgcgcattcagatgcacctgttctgatgctttctgcggcgagatgaatggcggttaaggatgaggagcatgcggtatcgaccgcgatgctcggaccgtgaaaatcaaacacataggatacgcggttcgggataaagtggtagtgggcccctgtcggatagttgccgttcatgacacccgcaaaaacaccaacctttttaccggcgcatagtgaatcaggggtatatccggcatcctcaagggccgcataagcggtttccagaaacagtctctcctgcgggtccatgcgctccgcttctttcggggagattttaaaaaacagcggatcaaatttatcaatgtctgttaaaaagccgccccactttgtatacatccggccttccttaccttttgtctcatcatagtagtcccgccaatcccagcggtctttcggaatttcggtgattccgtgttcaccggtttttaaccgttcccagaactcattaacattttcagctccgggatacttcccggcaagaccgacaattgccacttcaaggtgttttgacggcggttcggaggcgggcggcgctttttcagaaaaagatgccgcttggcgcttcgtcaatccggcgctttttttgcggctttgctttttctgtagagtgtgcggcaccttttcggcttctttatttgtcttgaaaatcccagccatatcttcctgtcttgagctgacgagatattccgctaatccgccgattgtcggatactcgaagaacaatgtgctgctgatatcagggacgtcttcccgcacgcggttggtcagctgtacgattaagatggaatcaattccgtattcttcaaggggcgtatgggcttgaacgtcctcaatcggcatctttaagatgacgctgacgatctgtttcagatactctgtgcttttttcaagcaaagagcctgatgataccgcttcagtatgacggacttcttcagaaaatcgcgcaagcagttcgcgctccttcgtttcagccaagtatgcggcaagctcttctatcgttcggtgttcaaaaaacagcgtgctgctgatatcagggacgagatcccgcagctcgttcgtcagctgaacgatcagaatagagtcaataccgtattcatccagaggagccagcggatttatctcttctgccggcatttttaatacttttgccgcagcccttatcagaaaagcagctgtcttttccgaaagcccttctcccgcttgtttgatggggagctgacgatcagagaatgttcgcggtacgtttgattggcgcttttgcgcggtgtaagcttccctgctctgcctgatgactccgttgcttttcgccgtgataatctgctgggtgtgcagacgttcgttttcagccggaaattgaatggaatgaaagccttcagccattaaaaccgatttccatgtttccggataaagaccggggcaccccggaatccgcagcgcctcgtcttcgtacagccaccagccctctaataagccgaatgtaacatgtgtaaacggcgtatgtccgcccagttcattaacgagcagcaaaccgtcttttttcaatacggcttttgccgtccgtaaggttttccggatatttttggtggcatgcagcacgtttgcggcgatagcgatatcgtaggttctcagatgtaatccctggcccgccgcaggcttctccacattaaacagctgatacgtcaaatacggattgtccgcgccgtattccttttcggcatgcattaaaaaagcttttgacaagtcggtataacagtattcctgaatatggttttgataggggcggagctttttaaacagtgtgctgctcgttccgccggtgcccgctccgatctccagcagacggatgtttgcctcaggattgtttttaattacattttccacataaatacacgcttcatttgccatcacatcgttgtaataatcagcgagaatgttatgcttatagattccttcaacgagctccattgaagaatcgggaaacatcacgtcagtggcttttattttgcctgttaaaatgtcaggcaaagcttgaatgacggtatccgccagcagagcctgcgctttcatatccggatctttcagccattcgtttttcttcttatgccactcttcccaaatcgcggccgtttcaccgcttttaagatcgctgtctaaaagacggatgctttcttccagccagcgctcatataaaggcagacaggaagccgccggcgcttcgccggtcagacccattgaacgcagcgtcacccgcagcacttgcagcaaaagctgattcaattctttcatttgattgcttatttctgttcttaaggataactgtgtacggtctttttgtttgtctcccttacccaaaaccttatcctcctaagaaaattaaatttgctccgtcattttgacaggcaatcagatagtcacaaattcatgagggttcattccctcgatcggaatcggcttggtcagcttcatcagccccatgcgggagatcggctgcgtcagcagagtttccagcgcctgcatcccttccgcccggctgatcagtccgagaccgattgcactcagtctgtcaaactcttcagaaatgtgattgtcagcccgctcccaatacccccagttcatcactttgaccgggcatgacagccgcccggaaagctcatgggcaaatgcgtctttaaatgcgcaccccgccgcataatgactttgattcggattcttaatatatgaaataaccgaagagaaaaagagaataaagtccaaagactctttcgcaaatacttcggcaatgttgacggaaatatccactttcgccgcaaggccggcgtgaaactgtgattcttccatatcttttacgctttcattcgcaaataccatcgctgaatgaacgacgccgctgatggtgccgtatgtgtttttaatctgttcataggcgcgctgaagcgatggaagatcagaagcatctgctgctatatattcgggagccgggcctgatggccggtaccggtctattttttggcgtatccggctgtccagcggccgcctcccgatccagacgactcgggctttatacgccgtcaccatataatctgtccaaacctcgccgatgcctcccgcaccgccgatgatgacatatacgcctccatatcggtaaggaacactttcagacggcccgctttggaccggaagcaattgaggccggtgccattcctgatgtctgcgcacccatgctttacccgtacggtcgcggggcaggctgaatatgtcttctgcagggaaatccccccgtcttcaagatcgaccagacggatgtgccagctcggatgttcttttgcgagagacccgacgaaaccgtgcacactggaatgagcgggacgcacctcatcatattgggtgataggctgtgcttggtgcgtaatcaccgtcatcccgagctgctcttttccatacccgagaccgataagagctttggccgctctgaaaatttgcagcaccccgcttttttgatcatggatgtaagaatcagccggctgaggggcaaaccagatcatatgctgaatctcaccgacacggcggagccgatcggatatcacttcaacggaagcactttggctgctatcaaatcgcacagctttaggaaacaatcgtaaaaccgcgtccgcctgcccgtctgtaccgcctatgatgacagcttttgcttcagaaatggggaagccggtttggttgtctatcggttccgcgtcccatacctgcatcagtttgacggctccggtaaggttacccggcagatcgtattgcttattatcggttacggccggcgcactttcggccatccgggcagaaaatccttttattcttacacacacattgccgcgttcatcacatatatcaatgtccattcttcgcacggcccgtgtttcatgcgtcacaaatacggccgcccacatgtttggactgcacggatgaaaaacggtcagttcatgcaattcaaaaggcattaacggctgctccggataacccgctttatcttcattcataacgccgatggccgcctgaaaagcggaatcaatcagactcggatggagcacaaactgttcggcctcatcacaaacggaagcagggagcaccaatttagccaaggcttctttttccccgcaataaatgtgatcaattccttgatgtgaaggtccgtatacaatttccgcctttgcaaatgccgcatagcagtcttcttttgacagcacttttttgcggcagcgcgctttcagctgttcaatatgcaaaaccgccgcctcagacagcggctcaatcacagcactgccttcacaataaatgtctgaatcgttttcattgctgtacacttgaaatgaaatattgccgttatcctctaaggaaagacctgtcgtcatacgcagcggctcttttttatgaacggcctggcgtatccagctgatataccgcagcgaaatgccggttttagccgtgtattcagcggctaacggcgcggcagccagttcagccgcggctctcgccatttcaagataagccgccccggggagaacacgcttgtttcggacgatatgatcggctaagaagaattcatctccgttcagtaccgtgctgaatttttgttctaacaaatctgatgtattgcggtgaagcagcgggtgaagcctgctttctgtatttacggaagtgacgggatgatcgggctccggtatccaatagcgctccttcgcaaacggatatgtcggcagactcatcctgcgcggtttctcctcccgatacagccgcgtccagtctatctcaaatccttttgaccacagctccgcaagttttttgtaagtgccgctgtccgtccattttcggatcagctcctccgtatcctgatcatcattcaggaaacccctgatttccgttccgctatcagaccggccttgaaagcagccgtcaatctgccgttttcgttctgtaaattcggttaatttcctgatcaggtccgcttgatcgttcactaaaaaaacaagccgttcttccattgccagccgtcccgtttgcagcgtatacgccagtgaccgcagggaaaaaggttcatcagactgcttctctaagccggactgaccgaaaagaccggaaagaatattcttatgtttctcatcgtttgtcagacattctgctaaagtccggacggaagtatgctgtatgagatcagtcatgtctattgccagcccgtattgatccgtcagccgctcagaaaactgtgtcagctgcatgacatccaagccgaattccttccaatcctgttcaccatctaccgagccggcctctacatgcagaacttccgccagagcaccgcgcagcgcattttccagctgattttgcattgtatctgttttgtcataaagcgacccgcttccttcaagcgctttatctttgagaaacatcagcaggcgggcagcgtattccttcagccgctccggatttttcgctgatagaggcacgatatacggtctctcttgattctccgtaatgccggggtttttgggcctgtactcttctaaaatgagatgaacgtttgaacccgtcgccccgaatgaactgatgcctgcgcgtctcggacaggaatgttctctgccgttctctgtatacgccggctttttccatgactcggttttttgctgcacgtaaaatggcgagtcctctaaacggagatacggattaatcgtctctgagtgcaaagaagggacaagcgttttgtgaaacagctgcaaaaccgttttatgaagcccgctgattccggcggctgactccgcatgtccgatattcgatttaacggaaccgatcgcacaaaattgccgatcctccgtaaacgtgcggtaagctttaacaagaccttgtatttcaatcggatctcctaaagaagttccggttccatgcgcttccacataagaaatcgtcctgggatcgatccccgtcttttcaagacattcagctatcatatccccctgcgccactgggctcggcacggtaatcccgctgacggttcccacgtgattgacggcgctgccttttatcaccgcataaatatgatccttatcttcttcggctttgtgaagcggcttcagcagcacggccccgatgccgtcagctgagacatagcctgtgccgccttcgccgaacgtgcggcacagcccgtcactcgaatgcatatccatcaagccgtatgtgatatattttgtcgggtgcaatgataaattgacgcctccggcaagagctgcttcacattcaccgcgtctcagactttccgccgccatatggacggccgtcagagatgacgaacacaccgtgtcaaccgccatgctcggcccgtgaaaattgcagaaatatgaaacccggtttgcgatcggcgcatagttcaagggataaggaaagaccagccctttggccgcagcttcagcgccggcgagagaataatccatatgcatcaccccggcaaacacaccgacgttcattctcttattcggccctttcggctgaacgattgtttccggggtatagcctgcatcctcaatcgtttcccagcatgtttctaaaaacaatcgttcttgcggatctttagcttctgcctcccgcggagaaatccggaaaaatttcgcatcaaaacaatccggatcgtctataaaaccgccccatttggaaatcggcttgccggacggcgatcgcaaatgctcatatttcctcgtatcccagcgggaacgaggcacttccgttacgctgttttctccattttttaaatttgcccagaattcacgaagatttttggcgccggggtaccgtcccgccatcccgacgatcgcaatatctccattctgcgttccggctgacgccgattttttcacgcggttttgggtcgtcctctttttttcccggcgcaaaggttcagcatttggatgcccgctttgagcatggccgaagccggctccgtaatgttcgcgcaaatatcccgccaattccgcgattgtcgtgtattcaaataacagcgtcggcagaagctgcgttccgatttttcgttcaatttcctttaccatgtccaacagccccggagaatccagccccatttcatagtagccgatatccgggtcaatctctttcacaggtttgttcaatcgggcggcaagcaattcttttaaataaaggatgcactgttcagtaaggccggcggaagcctccgcacggcggggctcggaaggcgccggttccgcttgcggagccgggacggcattccgcccgtcaggttctttcttttgccgtttctgattgatcagttccgggtccctcacccgtttattggcgaagtttttcagttcgccgacttttctgccttcctcattgaaaaactccattgtcacgtaaacgagatctttcttacgtgtgacggattctttttttatcttggtgatacatgtcgtctgcagcaattcggcgcaataaaatgattcataaaacagcggcagaaataattgcccctcctccctcgtcaaaggagcgagatatacattggagccgatgctgctcgcatctatcaatgcgggatgaaacatcgcctcttctgcatgttccagctgatccttttgcaccgacagatcaatataaatctctttttcagtctggtagacgcttccgcagcctttcatcattcctgaatgaaccagttcttgatccctgcattccgcgtaaatatcctcaagcggtatttctgccgccgtttgttttacggcatccatccggacgctctcttggaagccggcgggcttgacggaatgcatttgcgccgcggcatatatctttgtctctgctgcttcgtcaccttgtttttgccctttcacctctaccttccactgcccttcgccgttctctgtacagtcaacggaaagcaggattgtttctccctgttcaggagctaaagggtgaaaaatcgataagtgcctgagttcaaggccggcatgaaaaaaaccgttttctctgaaagtctgatagatcaggtcaatataagccagacccggcagcagttcctttccataggctttatgatgtttcagaacgggatgctgattgttaataagaagctgctcttgcatatgaacttcctccatatcgacgttcaattttcagcgcaatcagtaagtcttcatttgtttccaaaacgtattcgggcgggattcatgtgcgttttcatgcaggttttcagctttgtccggacggatgggccggcgttttaattcctgtctcggcaaaggctttctaaccggggtatacgcctcctgctcccaggcttccactatgacatgggcattcgtccctccgtcagcgaaactgctgacggcggcaatccgcggtgaatccgtccattcacgcagaacgtgcgaaaaataaaacggcgaggcggacagatcgtaatgcgtcatcggctctttgcccgaaaggaaaggcacacgcattcggcgcgagagcataagcactgttttaatgaatccggcaatcccttcagcgcataacgggtgtccgatattcggcttcatcgaccccaattcgcaaggcgcgctgttttgcatacggtacaccgcttcaatcgccctcagttccaaaaggtcggttacttcagagcctgaaccgtttgcttcaatgtagctgatatcctccgcttttctgccgcttttggcaagcgccttggccatcacttctttctgcgcctgtatattcggtgtggcaggccccgcggttctgccgtcattgtttacggaaatgcctttaatgaccgcatgaatccggtccccgtcttttacagcctgggccgctgtttttaaatacaccattccgacgccttctcccaatacgatgcctccggtgcggcggtcaaaaatatgaaacgcaggctcttcgcttaacagattgcgaagttcgaacatccggtgggtttgaccggattccagcagactgactcccccgaccaccgctgagtcgatttcaccgcaagaaagcgcctgtatcgccatattcataccgacaagcgctgaagaacaggccgtatccaaaacgagactcggccccttcaaatcaaagaactgagaaagattggccgccaagtaattcgggccggcggcgactatcggattttttgcatgcttcagacggttttcgtcaggcatactgccgccgcgtcctcctaaatagacaccggctgacctgcctttcatttcttgtaaagagtaaccgctgtctctgaacagatgaagcgcctcttctaatataagaaaggactggatatccattgccttgatgtcttcttcgggaataaggaaaaactccgggtcaaaatgcgttacattttttaaaaggcccgcataatccgccttctccgttttccagcgttctttcggcaccctttgaatagccgacgacccttcagacagcagcttccaataagcttcaattgattcagctccaggaaaacggcaggacattccgacaacagcgatgtcttgcgccgctgcagcgccagaaggctgaatgacagcggctgctgtttgtttgggaacgtccgggattacaggctgaaccggttttgaaacggcagctttgatttccggatatgccgtttcaagccatcccgccagcgcagcaaccgtagggtattcatacagcaccgccgggtcaaggtcagctttgatcctctttccgatcgctctggacacttgggcaagcatgatagaatcggctccgtaatcttgaaacggtgtatcagattcaaatcttgacggctccagtcttaattcccggcagcaaatgcccgtcagccactcctctacgctttctgtctcaccctgtacatgctgctttgtttcggtaaggccggttgaaagcatcagacggtcgggctcccatttttccgggtgaatgacggccggcataataacagatccgcaatcgcctgccataacggcatcaaacaggctcagcccatctctgtcagtgatgctctttaaaccgcttttctgataggcccggctttttgattcgcccatacccgtttctttccagctcggccattggatgctcagcaccggaaaaccttttgcggccgcaaaataatccatataggcgttagccatggcataatcgctttgtcccgctcctaattccggcatcacgccggacactgaagaaaacagcgcaaaaaaccggagaggctccttgtgcagcgcttgatacaaaaggtccagtccgtcagttttaggttcaagcacagtcatcatctgttctcttgttttgcggataaaggcgggatgatcgagatctacggctcccgctgcgtgtatcacgcctccaatcggtcccatcttctctttcacccggctgacggcctgctcatattcagggccggaagatacagacagcacttccgttcggacacctttttgttcgagctctctgattcttctcactttatcggaaaacggggaattccgtttgatatgatcatcccactccgctttcggaggcattgtttcttttccggtaagcacgagtttcgtgactccgtaacgttcggcaaaatgccgggcgaataaatatccgagtccccgggtccctccggtgatccagagcgcatggtctttcggaaatgaaaattctttttcagctaagctgtttgtttcctttaaccgcgcgtgatagcgcacaccgtttcggtaacacacttcgatgtctgcagaatcgcgaaaaaactcctctgcgatctggtttgccagctcggaatcttcggcagtccgttctgcatccatatgccgcgagcggatatccttatactcactttggagcatccggtacaatccggccttttttgcacctgagagatttatcgtttcattcgcaaaaggttcaagcccctttgtcacacaaagcagctgtagctttcggccgcggtttctgttgtcgatgagagactgcagacgatgaatccagccgtcatcatgcttgatttccgtcccgcatcccgtcacatcaatcagaccgccaaaccgggccgcgtccccggatatttccggtgatgcagcgtcaatgatttcagactcggggaaataacgggacagctcaacggccaaatttcctgtctggtgatcagcggctattccgatgacgccccgcacttccttagccggaacacggctgctttctgcccagcttttctgtaaaaagcggaattcacgaaatgtttcagaatgtgtttcagcaccgcgaacattgtccggcgctgcatcgtccggccaataacgatcctttataaatggataaccgggaaggctgacgcgatgcggcaggctgccgttataaagctctgaccaatcaatcttcagcccttttacccaaagttccagaagcttcgcgaatttttttcttttcatccatttacggacggcttcctgcatatcttcatccttaaaaacggctagaatatctttatactgtttgctttttcccctgaagcagccgtctgttccgccgtcaataaaacactgcagtttttccgctaactgctctgtcgacgtcacgataaacgccgcacgttcttccatcgcttctcttccggtttgaagggtgtaagccgcatcccggaggctgcggtctgtgacgtcattttttctgatcgcttgaagaagctgctgcgcccgctgcttcaggctggcctcctgtttggcggataataaaatgactgcgggatcttcatctgtgaatggctcagaaatctccctatcaggttcaatatattcttctatcaatatgtgggcatttgccccgcccgcgccaaaagaagagattcccgcgattctcggaatctctttctgcgctccgttttcctcaatgaccggccgtttccagtctgccaattcacgctgcaccgcaaacggcgtccggtcaaatgcaatattcggattcaagcttcggcaatgtaatgaaggggccagctttcgtttttgaaactggagcagcagttttgttacaccggcaatgcctgccgcggcttccaaatgcccgatattggatttaactgagctgatggcgcaaaagcctttatctgacgttttcgtttgaaatgcgcgggtcaaaccgtcaatttcgatcggatctccgagttcagtgcccgtgccgtgggcttcgatacagctgatcatccgcggatgtattcctgatttttcaagcgcgccggaaatcacgtcagcctgggcgctcggactcggcactgtatacccgtttgttctgccgccgtgattgatatgagtgccgcgaatcaccccgtaaatatggtccttatcagccatcgcttttgacagcggctttaacagcacggtcccgacgccttccccgggaacaaatccgtccccgccttcaccgaaacttttgcacgttccgtcttttgaaagcattcgataggcgctgagctccgcataagccgaaggatgcgtatacacattcacaccgccggcaatcgccatgtcacatgcgccgcgaaggatgttttcacacgcttcatgaattgcagtcagcgaagacgagcacatcgtgtcgaccggcatgctcggccctttcagattaagaaaataggaaactctgttggccgctgaactgaacgacgttttcggctgcagggtgccgccgtttttccagtacattccgtacccgtttttcgtaatgccggcaaaaacgccgacccggccgttatacagattctcaagctgttccttcgtataaccggcatcctccagcacctgccagcacatttcaataaagagacgctcctgcgggtccatattcaaagcatcacggggtgaaatttgaaaaaacagcggatcaaagaaagcggcatctttcagaaacccgccccgcttactgtaacttttccctgctttcacggccgcttcgggatcagggttgtagtacctgtccttttcccagcgctcttcgggaatttcggtcacacagtcttttccggccgctaagttatcccagtactcttcaagtgtttcagcttgcggataacgtccgctgactccgataatcgcaatcccttcttttgtctgtttctcattggaaaaagcaggccgttttcttcgcttgataaacgacggaagcaccggaaaatcttcatttgccaaaacctgttctgatatgcctgaacggtgctcatcatcatttgtccattttcggcattcattcggataatccgtgacaaagtgagctgccagggagcccagtgtcttatattcgtaaaaaaccgttttggaaaggtcaccgaaaagcagagacaattcgcggttcaatttcgtcacagtgacggagtcgattccgtaagtttccagcggctcttcagtatctatgttggaaacagcaatttttgcagtcaggccaaaaagcgttttgagctgaagaagcgtttgttcatacaaacgttcactgcggtgttcggcattggtttttccggaagcgcccgtcttgatgacaggctgcagcttcaaccccgacagagaagcccatatttttccttctccgtcacataaatcaatataaaagctccccgccttctcttgtatctcggcccataccttgtcaggacaagattcataaaacaaaagctcgtccaatgaaaccggagcgagcgttttatattctttgccgccaagcagcgcgcatgcctctgtcacactttgcatcacacagggagggaggccgaatcgggcggattctttttggtttgtcaatggaattgatatgtctgccagcatccgtcctgatgaagcgtaaatacgctcaattcctttcatgtgctcactgtattgaacggtatcgttctgagtgatggcttcaatttgctgcttatccatcagggaaccgctgttttccttcaagcggctgatatccagcatgccgggcgcagcatcaactggctgaatcgtcccttggctgtacacatcataatgactggaatcagcagaaaatggattataaatctcaaaccttttggcttcaccctctgcgggtatcagcctgatttcgatatggaacggctcagcctcagtcagaatgggctttgaccacacgatatgcgtcagccggacagccgcagtctcctttactgtcaaaacagccgcagctctcgccatttccaaaagaagttctccaggcataagctttttatgctgtaaagaaacatcagcgagaaaaaattcccggccgctgaaagctgccgagaatccctgtcccgtttcatcggaaatatgctgctgagcaagcggatgaagggaatccgtttggcgaagtcccatccgcatatcataatcgcgcaaaatgccgatcgcatcctgttttgtcatttttttatttttgacgtcagaaaaaacccggtgcagaaactctttcatatggtttcctccattacgctaatccctgtaaaaaccgatcgttctttttacagcggcttctatgcttatttcgtttttctccaattcatcaagcaggcgctcataagtctcaagcggggacgtatcagtcccgtaagtctcccggtgccttatatgctgcgcactgtgcggtatccagcaatgtgttttcgcaaaaggatagacaggcaggctgacttttttcggtctttcgtcctgatacaatttactccaatcaacatgcaagccttgcacccataattttgcaagcattgcatactttcctgcttcaaaccattgatctacggccccgctcatttctgcattgtccgtcatctctgtaaacagctgtttcatcgctttgttccggcctgtaaagaaattctgccccgtctccttgccgctgaggaaatcattcagcgcgttcgtaagctcttcttttgtttcagcaatgacggcaaggcgctcttccatttcatcccggccaagctgaagcgtataagcgatatccgcaagagctccgtcagctgaatgtgacttttccaaatatctgcgcagctgttccgcacgttccttcagctgttccgccgtctttgccgagagaatgaataaggacggctgaagttcaccggccgtccattgtttctcttcaacaggagaaacatattcttcgagcacgacatgagcattgacaccgccaaatccgaacgagctgacacccgctctccgcggcagttcatttccgctatcatcagtcgccgctttccacggctgagtttcgcggacgaaataaaacgggctgccgtcgaggctgatatacggattaacggtttcacaatgcagacttttaacgagcgttttgtgctgcatctgcaaaataatttttaaaagtccggccatgccggcggcaagctctgtgtggccgatattcgttttgacggaaccgaggccgcaatgaggctgatcgggtgccgttactccggctttttgataaagcgctgcaaaagccgctttgagtccgttgatttctatcggatctccgagcgccgttcccgtgccgtgggcttcaatataactcactgtacgggggtcgatgttcgcttgctgatacgcttttatcatgacttctgtctgcgctttcggattcggcgatgtaagggaagccgcccttccgccatgattttccgccgttccgcggataacggcataaatacggtcgccgtcacgttccgcatcagataatgttttcaaaacaatcatgccggcaccttcagctctgacatagccgtccgcttgatcggaaaatgttttgcagcgcccgtcttcactgagcattcctgctttattaaagctgatatgcatgtccggcgacacaatagcattgacgcctcctgcaatcgcgatgccgcagtctccggcctgaattgccctgaccgcacggtgaacagcgaccaatgagcttgaacaggcggtttcaatcggttcgctcggcccatgtatattcagaaaatagctcatgcggttcggaccgattgacggaaccgttccggcagcggaagaaccctcaatctctatatggaactttgaagcttcctgagcgtaaccgctgtttgtcgtgcctgcaaaaatgcctgtatttgtacctgacaggctttttgcagagcagccggcatcttcaatcgctttccatacatgcatcattaaaagtctttgctgaggatccatcatttcggcttcatgcggagaaataccgaaaaataaaggatcaaattgagcggtttcatcaatgaagccgccccactttacattgctcgcatttttatctttctgcggatctccgtaatactgtctccagtcccagcgctccggcggtatttcagaaatacagtccttttctccggctaaattctcccaaaacatttccggattttcagccattggaaatgcacagctgattccgattatcgccacgggctcttcaggttcagctgcggtttttgttttaggaaggcgggacggaatcgagaatggctccgtcttcatttttttacgctcaaccggtttctccgtttctgtttcttcctgtgggccgaatgtatccggatgttccgtcagcaagtattgggcaaaactaaagactgtcgggtattcaaaaaacacggccggcgtcagttcaagcccatacattttatttagttcatttgcaaactgcgtgaatgaaaccgaatcaaatccataatctctcatctctgattcagcatctatttcttcttctttcaccttcagaatgcctgatatcatatgtttgagttccgcttgtactttatttggcagatggacgtgggtcttccttgacacatgaatgctgcgtgacggttccggcgcttcaggcatcaggttttttcgaatccgtttctcgtcgccttctgccaccatgacctggtgtgctccggaggcaaaagcggcgtacagcgcctggatgcctgaagccgatcgcatggctttcattccggtctgttcatacatcagccgttctgtctctttgtccacgcgcataccgccttcttcccaaagcggccagttgacggacagggtctgcccgctccgcttgttgtcccgcacgagacgatttcggcgggctgcatatacgtccataaatgcgttggctgccgcataaccggcctgccccgggtttcccatacctcccgccaaggaagaaaacagaatgaaaaagtccagccgcgcatctttcgctgcttcatcaagattgataagccctttcaccttcggcgccatgacggtcttccgttcgttttctgtctggttcagaatgtaattgtcggcgatcacgccggcgccgtgaatgatcccgtcgagtgttccgtgctcctcctgtatgccgcggacgagggcgatgaccgccgccctgtctgtcacatcaaccggttgatacaatacgcgggcacccgacgcttccaagcgccgtaagcgggcggagcggtctttatcaagcgcttccgcccttcccgttaatatgaggacggcgtttttgacgcgggaggctatttcttcagcgaaaatcagcccgatgccgcccgctcccccggtgaggaggtaaaccccttcgtctttccacggaacggcgccgctttgaagcgcaggcaggtgacgccagtttctgacgagacgtttgccggcttgataacggatttccgcttgttcagggtgcgtccggttttctttcagcttggcaagaagcgatgatgctggctcgtccggatcggcttggatgacttggccgtacagcttcggatgttcaaggtgagccgttttcaggaaagcggccagccccgccaatacattgtcttcccccctgtcggggacaagaagctggatcagcgtttttcccttctgtttttctttgataagacgcttgacgatcgctgacagctccgccgcgcaggcgtcataacggtcttcaatcggaccttccccgtcagccgcacatacggcgccgtttatgtcctcagcgttcattccgccatacagcgtcacgtatctgaaagactctgcttgtccgccgccttcacccggcggtgattcctgccactttggctgaagcaagagcggttttccctccgtttcctcttccagaaaacgggcggtgagccccgtcaatcggacacatacctcgccgttttcatcacacagctcaatatgataggcgccgtccgctgaggaaagcaccgcccacatcgtctcccggcacgcagaaaacacctgcatatcttggagggcaaacggcagaaacggccgtccggacgcggaaccgtctgagtgcacgagaccgatagaagcctggagggcggcgtccagcatgctcggatgcaggatgaacggctccttttcttcgcgggcgtacggcggaagagtgagcttcgcgagcacttctccgcttccggcatagacggcgtcaagcgcctgatgagacggtccgtaggtgatgccgagactgtcgaatgcttcatagcactcagcctttgacatgcgccggccgccgcagcgcgcctgaaccgcctccacatcgagtaccggagcacgctccgtctcttcgagcacggcctttccctggaaaaagacaagcggctcttctccttcggcatacgcttcaaaagcgatgtctccgttttcttccggctgaagctttacatgaagcgtcacgccttcagaaagcgccgtcaccggacggagccaaacgatctgtttgagccggacacccgctttcccgcccggcaagccctcagcggcaagtgtaacggcggcccgggccatttctaaagcagccgcgcccggaagcaccggttttccattgacgatgtgatcggcaaaaaacggttcacgccctgaaaaaacagaagtaaagcgctgggcggtaaaggtcgatgtattcgcgtggagcagcgggtgaagtctggctgctttctcactttccgctgagcctgttttgtcaagtgacacatcagcttttgtgacccaatatcggtctttggcaaaaggataagccgggagactgatgcggcccgggttgcgctgataaagagctgaccaatcgacgtcaagtcctttaacccaaaggtcaagcagctttccgtatttcccttttttcagccaggcatttatggtaagcgccatatcttcatcagaagtgagcgaagccgccaatgaatgatgtttggctgtcctgccccgccagatatgagcatgttcgatatgatcgtttgagaaactcataagcttcattttcagttcttctatcgactcggccgtaaatgcaagccgctcagccatcggttctcttcccgcctgaagcgtgtaagcgattttggccaaatccccgtcagaacgtttttttcttatgacatcatccagaagctggcgggcgcgctctgtcaattgctgctcatttcgcgctgataaaataataacagccggtttttgcggagaaacagacgcgttttcccttggtttcaggctgtcagacggcacatattcctgaatgatgatatgcgcgtttgcccctcctgctccaaaagaggaaataccggcaattctcggatattccttcatttcacccgtgatattcaagacaggtcgtttccattccgtttctttttgctgtacgaaaaacggagtgtgctcaaactcaatattcggattcaattccgccgcatgcaatgaaggggcaatcctcttatgtttcaattggagaagcagtttggtgattcccgcaatcccggcagcgctttctaaatgtccgatatttgatttaattgaaccgatggaacaaaactgccggtcttctgttgtcaggcgaaaagctttcgttaacccgtcgatttcaatcggatcaccgagcgcagtgcccgttccgtgggcttccaagtaactgaccgttctcgggtgaatgtctgtccgtttcaacgtctctgcgatcagatcaaactgcgctttcggattcggcaccatataagcgtttgtcctgcctgctgcgttcagcatgcttcctttgataacgccgtaaatatgatcgccgtctttctccgcttgagcaagcggctttaacacaatcgcccctactccttcaccgtcaacaaaaccgtccgccctgtctccgaaagatttgcatttatcaccgggagacagcattgaaaaagcggacagccgctcatagtgagccggatcaacgataagattgactccgccggcaatcgctgtttcactcattccgctccgcaggctttctgcagcgagatggacagctgttaaagaagaagaacaggctgtatccacagccatactcggcccttgaaaattgaacaaaaacgatactctgtttgcgatagaccagtcgctgggaactgtcgggtaattgctgttcatcacaccgacaaagactccgattttccggctgtcacaaagcgtggccggggtgtaccccgcatcttcaatgcttgaataagcagtctgcagaaacaacctttcctgcggatccatcctttcagcttccgcgggagatatacggaaaaacagcggatcaaatttatcaatgtcatcgaggaaaccgccccattttgaataaatggacccccattttccgcgttcctcgttataaaacgttttccagtcccagcgatctttcggcacttctgtaatagaatgcctgccggcttttacattttcccacagctcatcaacgtgatcggcgcccggataccggcctgacagaccgatgacagcgatatcctggatatagggatctccgtttgtcctgctttcttcctcgttttgaggaattacattcaggttatctgtgtgatcagacagctgctcctcacgcacacccatcgctttcataaatgctctccgctgagaaagaagcaggtaatccgcgatttcttctatcgtctgatattcaaaaaagagggtgctggtcatttggtcaaacacgttacgaaaagcatttgtgagcctgacgaccagaatagaatccaaaccgtatgcggttaaggaaaccgacggatccattctcctgctcggaatctttagcgtttttcctattaattccgtcagatatgtgatgccccgttcccttacgtttggaatcggcgcggcgctttctgcgggagcctgcatccgtccggcgttttcggaatgagcccgtccattcccgaattgccgctcgagcgcttctttacgggaagacagaaagtaatcagcaagctcatcaatggtttgatattcaaaaaacaaagtgctgctgacagaaccgaagacgtcttttaacgcgttggtcagtctgacgaccagtatggaatccaatccgtatgcggttaaaggttcatgggataaaagacgatgcgccggcactttaagcgcttcaccgattaccttcttcatcagttcaacgcttttttctctcaagctgaaatgcaatgtatcatccgaaagaccatctgcgtcatacggacggcgctccggtttttcttctgacgcctgcgggagggcaagcctgaccgttccgtcactttcagccgctataatctgctggcctaagtcgtgtgcggcttcagccggaaacagaggatggacgaacccttcaagtgaaagcgcttccgaccagccggccggctcaacccccggacagcccggaatccgtaaatcatgatcctcatacagccaccagccttcaagaaggccgaacgtcacatggttgaatacggtgcggctgttgatctcatttataaacagctggccgtttttttgcagcattgctttcgcatggcgcagcgtagagcggatattttttgtcgcatgaagcacattggtcgcgatcactgcgtcatacgtgccgatgtccggcgcttctgttgataccggctgctcagcgttgaatattttataagtgacataaggatattccggaccgaatatgtcttctgcatgtaaaagaaatactttagaaatatctgtgaaacaatattcggcaatatgcgcttcatacggtttcaattttctcatgaccgcggcgctcgtcccgcccgttccggctccgatttctaaaatgcggattttcgcctgcgggtctttttccagacgctcccgcaaaactgcaatcaatgtgtcagcaagcttgtcattgaaaaaatcagaaatgatattattgcggtaaatgccttccacaagacggaaggaggagtcagggaacatcacttccgttgccggaagcttaccggttaaaatgtctggaagcacacgcaatgtctcttctgccaatctgacatgcgccctcatgtctttccggcgcagccaagtctcttttttccgctcccattcctcccacacctcccctagatccgttttttccggagcaagcgctaattcagtcaggaagacaaagctctctttcagccatctgctgtattgttccgttatgccggcagccgattgaaataacggcaaagtctcatcaagccttgcgcccatctcataaagggttgatacaagtattttttcaatgagggattccatctctctcatgcagctcatgacatttgatgcttttacccgctcagcttcgtcattctgcgtgatgttaaccgctaattgtccgagtgcggaaggaatcttttccggataaaccgttacttgttctttcagatcatctttcataaaaaccggatctgtcgttttgatcagcgccagctggtcataaggtcccgaaagcagggtttccagcgttttcatcgcttcgggcgcctcaatagaagcgattccgtcccgctccatccgtttccggtattgttctgaagcgacaacgccgacacttccccaaaagccccaattgacaacctttacggcatacggcgctttttgtgagatccgcttagcaaaagcgtctttaaacgtgcacccggcggcataattgctctgtcccggcgctttttgaaacgacatcatcgaagagaaaaacagcaagaaatccagcggttccccttcagctacccgggcaatctgcaagctgacatcagtttttgcagaaagtgaagcgcggaactggtcctcttccatattggcaaaactccggtctgataacacgatggcggaatgaatgattccgcgcacctttccatgttccttcacaatggtgtcatacgcccgcttgagagaatcataatccgcagcatccgcgctgaaatattgcggtgcgggacctaaagccgcaagtcttttcagctttctttcaatctgtgtatcttttttccgtctcccgatccagacaattttcgcctgataggtctgaatcatatattcagtccatacttctcctattccgcctgctccgccgataatcacataaaccccgccgtgccggtataatgaaggctcacctgcatgaggctggcagacggccaattgctggcggtgccactgacctgcacgaaagacccacggatttccctcggggtccgccggtaaagagaagatatcgggaagatgccggtctcccctttgagattccaaatcaagaagccggatgctccaattgctgtattcttttgcgagcgcccccgctaatccgtgtatgcttgcatgactcggattgacctcatcatgttcatgaatcggctgtgcttgaaacgtgcagattgtcaatgatagttgttccgtgtcaaaattcagaagcagaagcgattttaccagccggaaaagctgcatgaccccgtgctcctgtccgtcggccgtatccgcatcataaacggatggaatcggatgatccggcgccgcccatatcatgtgttgaaaagagccttgcgctttcagtgtttcagctatttgttccgcgctgtccaaagaagtgatgtccggaaaacggacatcggaatacatctctttcaaagcctgctgaaaatccggcccgcccccgatgacgattattttttcttcacgcatgaaagacatgccggtttccggaatggtgacggtgttccaaaccggtgtcataagcaattccgtttcacggcttttcttcggcatgacgccggctttttggttaaacccggcgctttcctgcacctcttttatgataaaatctttcactgccgccagcagcacaccgcgctcatcacaaatatgcagatcaaattggtgaacggaggccgcttttacctccgcatgcacaaatacggttttcgctaacggtttaagcagctgtatttctccgaaggaaaacggtacgataagcgcaggctctttttgaaattgcagcacatgcgccattgcagtttgaacagcgccatccagtaaggacggatgcaggatgtactgtttaaaatccgcttccaagtgtgacgggagcgttaatttggccagtgctttcctttctgtataagagaattcgcggatgacctgaaaactgtccttttgcacgattcccgcctcagagaacgagtgatagatgtctttcggctccgttctctgcgtaaatggcgccggaagctgaaagaccggggcctcaaacgacgctccattttctttacaaatcacttctccttgcgaaaagagagtgccgtccgctcctttttccttaatgacatagcttatacgctctttttccgcttcaaactctatcatgacggatcttgggtctgtccctgtcacaatcggctccatataccacacattttgaagagagacgaccgggcgttctccccacaatgccgcgccgtatgccgccatttcaagatgacagactccggggagcacatatttttcgttcactaaatgatctttaaagaaatattcatccttggaaaatatcttttgaaacgtccctttccgggcggatgaaacattctcatcaagcagcggatgcagcgcttcacgccttttgacagattggggctttttcgtataccgctttttttggtcggtcagccaggacgtttcctttaaaaacggatacgtaggaagcggaactttctgatacggcgtctccggctttttgaaaccttgaaggcctttgacccacagcgcggcaaatttttcaggatctgaaacggattggcctgaaacgtccggccgtccgggtgacgcttttccgaagtaaatatgcctgccgccgctgtgcccgctcacaaagccgtccaatcgctgtttcagctcgggaagggatgacgcaatgacagcaagccggaaggagaaaggctctctgcctgacaatagggtggcagcgatattttccaggctgtatccgccggcagaaggcgagttttccaatcgggcaagaaaggagctcaattttccggcatattctttcagctgctgttcggaatgtgcgcttagtacgacggcatgcggtttttgctcagtattcccgtccgcttgccgttttggctgataagcacctacgatcagatgggcattagagcctcctgcgccgaatgaactgattgcggcgattctcggtttatctccttcagccggccacggccgattgtttcggacgacataaaatggcgaatcagaaaaagaaatcttgcggttcagttcctcggcgtgcagactggcgggaagcgtttcatgtttcatgcttaaaagcaccttgattaaaccggcgatccctgcagccgcttccaaatgtccgatattggatttcaccgagccgattccgcagtcatttttctcatcggtctgtttctcaaatgccatagacagaccgcgtatctcaatcggatcgccgagtgccgtgccggtaccgtgagcttcaatgtagctgatatccgccggacttaccgcggctctgtttatagcggataaaatcaggtcccggtgcgcttccggattcggcaccgtatacccggtcgttttgccgccgtgattagtggcggaccccttaatgacaccgtagatgtggtcgttgtccgcaatcgcttttttcaatggttttaacaaaacggctcccgcgccttcaccgggcacgtaaccgtctccgccttcaccgaagctgcggcattttccttcagaagacagaaaatgcgattggcttaaaaacatgtatttttgcggatgtaagctgaggttgacgcctccggcaagcgccatttcacagtcgcccgacataatggcctgacaagcctgatggacggcgacaagcgatgaagaacacgccgtatcaacagcgatgctcggcccatggagatcaagaaaataagaaacccggttcggaatgccccaatataaggagccggggcctttatactgatctttgaggaaaccttcttcgtgtgcaattaatgaatattcattccaggtcactccggcgaatacaccgatttgatccgtcggcctcgccgccgggttcccgtaaccggcatcctccatcgcttcccagcagcacgtgacatacaatttttgctgagggtccattaaatcagcttcccacggggaaacagaaaaaaacagcgggtcaaatcgatccggacgatcaataaaacctccccatttactgtatgacgcgtattttgccgttttctcttccgagtaataagagctgtcccatctgtcctcagggatttcggagacacaatctttattttccattaaattgtcccaaaaatcatgctggttttccgctttcggaaacatcccgctcattccgataaccgcaatatcagaactcctgtccgttcccggttcaggcaccttttcagccgcctgtacaggaagcacttcttcttcctgccggcttcccgtatcaggctccgtttctttgaattcaagaacgctttcgggatttcgtttctgcgcacttaaaaactcactcaatttctcaatgttcggatattcaaacagcagcgtttcagaaaggccggtaaattctttatgcaatatggtcatgatttcttcactgatgagagacgtcacgccaagagtaaaaaaagcggttttatcttctgcttcggtcacctcggcacccagcttttccgctattaccgttcttaaaaattcgttaatacatttcatgaggataccatcccttgtacaaaagaatttttctgtgctttaacaagttaatccgccgtctattgccattgtctgtccggtcataaaggacgattcaggagaaagcagaaaacgaacgagtccggtcatatcgtctgtttcgcctaaacgccccatcggcgtccttctgataatctgcgatttttgtttttccggcatatttttcgtcatatcggtgtccacaaaaccgggcgcaagtgaattgacacggattcctttggacccgagctccctggccaggcttcgcgtcaagccgtcaagagccgctttggatgcgctgtagactgaagtgcctttaaatcctcttgaaccgataatggagcttatgttaacgattgatccggaattttgtttcagcatgacccgggaaacgtttcgggtcagcttgatgactgaaccgatattcagattgaggatgcggtcaatgtcttcatcattggtcaggggcagcagctgatcaaggttcaaaccggcgttattgaccaagccgtctattctggaaaacttgcggtacacttgaagaacaaactgtttcatggcggcatcatccgccgcatccgccgcttcccaataaaagcggtcacggtacttttcactctctctcaatgtgttaataaaatcagattcactgcggctgaaagcggctactttgtaattctcatccaaaagcgcctgtacaatcgcttttccgagcccccggctacctccgctgacgaccgctacttttccgttattcatatttgcctcctgttttatacgtttcttatttttttaaatcggtcattagacagtttccgatctgtaacagagatgatctgcggtatctgatatggctgcagcttctgtctgcaatgagctacggcccgctttctgaaagatttgatatcttcctctttttcaagtacggcctctgccgcgacaatctcgcctgtaatcggattttttcggcccgttatgagaacatcccggacattaggtatctccagaaagacgctttccacctctgccggaaacactttctctccgcccacattaatgatttcactctttcttccgagaattcttatatattcgccgtctgtttccacctggtcaccggtgtcgtaccagccgtcttcatcgaaaggtgagggtgcgtttaaatagccgagcatcgccgactcagaacggacccaaagcgtgcctccggtaattttggtctctgttccggcaccgcctactttcatccaagtggattggctgtcttttgatttcgttgagaatatacccagttcagttaatccgtatgtttgtttcagccgtacatccggaaacagccggtgaatgccgcgcagcgttgattggggcatcggttctgtgccgtaagtgatcagctggagtgaagacaggttatagccggcatccgccttggacatcagcagcatgtttaaaaaagtaggggtggcggggagcacttggacagcatatttgtcgaccgcctgataaacggactccggcgttctgctgtctgatgtgacgatcgttcccccgttaaacagaatcgcaaacagcgtattaatgccgcctatatgatccaatttcagaaaaatgagcgtacgcagcggttttctcttcgccgttttgtatttttcaagcagccggccggcgcttaacacggatgctttgcttttgccggaggttcccgatgtgaaaataataatgcctgactcccctttctcgcgcaggtcatcaagcagagggtgagaggcgctttcagaaccttcacgaagcgtccagctgtcattttcatttatttcaatgatttgattcactttcgcgtcttcaaacatatcgagatgcttttcccttgattcattgctgagagggacaacgatatttcggtttaacaaaagcgccatcagcaaaaaaatggcgttcggggaataatccccgataagcgccacacattctccttcacgtattccgttttgttcaagttctttctgaaaaaagctgattcgtgtcagcaaatcatcatacgtaaaagtctgccctttaaaaatgagaaactcactgtcctgcgtttccctaagcttatcagtcacccagctgatatctcccctgctttctgttttcatgattgagcactgtccatgtatttttgataaatatcacaaatgctgccgacggttgtaatgctggaaatcgtttctccttgggaaaaaggatccactccggtttccatctccatctgtgcgactaattgagcgatatccagtgatgagaagcccagatcctctatgactctcacatcatctcccgcttcgacggcccgatatgactgctgttcttgaatatcctgaataatttgagcgatgatctgcttcatttccttggtttgttccatttgctttcagctccattcttcattttataaacttctgatgacccgtttataatccggaatatgatcttgtgaagaggtcggcaccgccagcagcttatccaccttggaaatggccagcaatgtatgattccttttcatatagacttcaatctgatagctgattttcgccactgagatcataccgagggactcaccgtgaaagtcgggatcgcattcttcaatgtgtcccgtcatataaatatcaagctcttcatctgcaaaacaatttccgtaataatacgtctctctttcaagcaaaaataaatgccgcgcgattgaaaccggaaaacccggcttcgaccggcgcgtcatccattcaaattccgccgcatccattatcttgctgaatttcgcaaacaccatggcatgccccggcgcagcatcctgatcaacaggaacccgatatgaaacggggtccgctgttttgaggtttcccggcttcataccgaaagcgtccgttctgactttctttgaccgcatcagcgcgtaaggcggcttggctagcttagaaagttccgcaatacattcagccttcggcgctgagactttgcgcgtcgaaccttctgtttgtgtgacgtcaacgacaattaaactattggctttcatagaaggaaaccgtccccggtcccactcgcttttatcagagctgaccgctcctttcggcccgaacaaataatcagattctaatatggtttctccaaaccgggagatatcgactccgacggaaacctcgtcccataatcggtactgatcaagaggcttatctgaaggaactttgagatgtgtcataaaataagccggatacaaaatcagcccttggtgatcggccatctgatcaggccggaatcccgttccgtccgttaaatggtgactgtgtgcattgccgaataacagcagcagcgcgtactcattcaaattccctaatccgacatggctcatcgttaattcatgattttcaatcagcatggtagtcctccgcagaaaaaatgtaatgtctggtcatactcagcctgtaatcgataccagcctttgcgcaagaaggccggctgtttcttccatgagctgtttgccgatcaagtcgacatgcctgtttctccaattttcaagaggggttcctttcacccattgattaaacgcgccgagcgcagggccgcaatgaatttggtaatctattttactttcgctttttccttccagagcgagcctcgtcgtatgggaaaaataccatttaaataccatcgccattttgtgtttcggattctgttcggctttggcgatctgttcaggagatttatcacgtttcaactgctcatacacttcctcaaaactgcgctggaaatacttatcttcaattaatgttttcgttttttcatctatttcatctaaagaattgtattgtctgtacaagtcaaagagtttattggctcttgccgggaaaaacaggccttttttcagcacctgcacccttgctcccgcttcaaacatatctcccgcgggagcgtatgacgtatcctgcacgttcgcttcctgaagcagatctttcactgaatcacttgtcccggcttcgaccgtgcattgattaatagaaccggttccgataaattcggcgccgagcagaaacgcggcagcagccgcttccggagtgccgatgccgcccgctgcgccgattcttacttttttcgcataaccgtgcttctccatcatgcggtctctgagtctgatcatggcaggcattaatgtatacggaatcccttggtcggtatgccctcctgaatccgcttcaacgcaaatgtcatcagccatcggaatttcttttgcaagcgccgcttccccggctgtcagccgattgtcagacacaagtctttccagcacatgagccggagccggattcagaaaggcctcagcgacttcaggccgggatactttcgcgatgattctgttttggactgacaccgatccgtcatgattcctgcttaatccctttgccctgtatatcacgagagccggggttatgcccataaatgccgatgcttcaataaggtgaatgccgttttttaaatataaatctatcattctgacttccttgtcaggtgacatcatatgatgaagaagattcattccgaatgtttccccttgccgcagtgcagaccggatggttccgatggcctgtccgatccgttcgatactcaatccgcccgttccgaaaaagcccagcattcccgcttttgccgctttaatgaccatctgttccgaagcaattcccctgtacatggagcccgtcatgtaagcatattggatgttataatcttttttaaaatcttcgttccctaatctcattcccgccgttttttgggaatcagctgccgatgctttaacatcagcagtatcagactcttctttcggcataggtaatgggacggcatcttttttaatctgcctcgtcagttttgtcagcacttccccgggcccgacttctgcaatttcattattttcaagtcctatcagacggcgtatcgtgtccgtccactttacctgattggtcatttgcaaagtcagatttgttttgatttcatcattcttataaggtgcggcatgaagatttgagatcaccggaaaacgaagaggcaaaaacgccgtttcttctaaataatccgcgaactctttttcagcatctttcatatagcgggaatggaaggcgccgctcacatttaaaggaagatacattctcacgccggctttttcaaaggcggggcccgctttttgaatgtcttgtttcgttccggcgatcacaatttgcgaaggtgaattgtggttagcgatatcaatgccggtcagatgataatcggatagaacctcttttacttgttcagccgtaaaccccaaaaccgccgccatgcctccgggagctgccttgctcatgagctcccctctttttttcacaagctgcaaaccggtcttaaaatcaaagcagccggccgcaaataacgcattatattctcctaaactgtgccctgcggcgtaatcgggctctctgccggactctttaatcttctttaaataactgagtgcacttaccgtatataacgccggctgggtaaattgcgttttccccagctgatgattcggatcctccaggcacaattcttctatagagtagcctaatatgtcatcagcctgacgtgtcagatcttgaaattcatcaaacagcccggctcccattcctttaaattgagaaccctgccccgggaacacaaacgtaagcatcttatcctcatcctttccccatcgccaattttgtacatcacatgtggttctccatacaaaaacgtctcttatttcatatattgactggtgtaaacaccgccataaaaataaaaacacaaacgcgtttgcgattcagcacaggtttaaaaatcgcaaacgcattgtgttttccttttctaacataatttatattaaaacatcttgcttgtttactgaatgtttcgcatgacaagctgcagtgccaatatgcccgaaaacagccatgacggcacacttctcccttatcatgtatatgtagatatatacactgcaatcatttttataatccctatttcctcttcaacgtgccgaaacagcgattgaaatttaataggtgctttactttaatttaataaatttaacaaatagttgctatttaaagagaataatatcaatttatagataataatgtcaaggctttatttcgttattttctgacatttattccacagttttatattcggtggacagtcggcataattgtttcgggataaatgtcagataattccctgaacccttttcatgtcaaagaaaattcatcgcctctctgtcaattgggtctatacttatttttcattttcatatattatgtaaaaaaaagacgaattagaaaaatttttaatcactttaaatactatccattaaatactttctttgtataataatttcttattattctaaggaggatccagtcatgaaatggtacgcactttttgtagagtcgggaaaagaagaagcagttcaaaaatttctgcgtctgcagtttgatgagcaggctctctactcaatcatacccaagaaaaaagtcacagaacgaaaagccggaattaaatacgaggcactcaaaaagatgtttccgggatatgttctgtttaaaacaaagatgacagagcggacatttcataaaatcaaagaactccccatttcatgcagaatcgtgaataacggagcatattattccaaagagcgcaaaacctatttcacgacaattaaggatgaagaaatcctccctattatcaggctgatcggagaaggagacactgtagattattcaaaagtctatattgaaaattcaaaagtaaccgttgcctcagggcctcttaaaggaatggaaggcattattaaaaaaatcgataaaagaaaaagacgcgccaaaatctgcctgtcttttatggggctggacaaaatggtcaacgtcggaattgaagtgctctccaaaccctagcatttcaaaaaaagcatcaacagcatgtgccgttgatgccctttttatataaacagacgaaagcccgacatcaaaataaccccgctcaccaccgtcacggtcaaatttttgttttcaaggcatagttgacctgaagccgggctgcgcctatgagacaaaatcacatttaggggaatcattttaatcaagagcggtgaattgacggttgagcttcatgacgaaaagcatgtgctgacttcgggcgatgccgcacagttattttcattcctcggaaccgatgacatatttattgctggtctattatcctgaaccggcttaaacgcatatcaggcttcttcaggcagaagcctgatggaccgcaacccattcttgtatgcattgaatcagtttctggacagaaggtgtctgcgtctcctttgcacgagctgtcaaaatgccgagctgcctggagacataccggtcgaaccgtttgatgagcacatcaccatcattcaccaaaagctgcggcaagatgctgatccccagattattccgcaccattgcaataatcgcttcatcccctctgatttgataagcaacccgcggagtgatcttttcttcctttaacactttcagcacatcaaaatgtgtctccggataaggcacgatacatttgacggactccatgacatgtaacggaaccgtttcatattgcgccaattcatgctgcgggctcatcaccgctacaatcgggtcctcggccaacgggtaaaaatgccacttctcgctgtgggatgtcccaatcgccgcatcaatccggtcatctttcagccattgttccagctcagtagaatttccatcaaataaatgcaccttaatagaaggatacagctcattaaattccctcaaaattttcggcagccattttaccgccacgctcgtaacagtgccgagccggacttcccctctttctaacccattaatattatcaacggtttgagacagtttttcatagtttttttgaatttccttcataatatgtaacactttcaagccatttgcggtgggcctcactccatgccgctgtctgatcaaaagcggaaaaccgtactcttcctctaatttactgatcatttggctgatgttcggctgtgtgtaattcaatatggcagcggcttgggtcaggctgccgctttctaccgttttaataaaggctaaatgcttctttaaatccaatcggcttcatctcccagatatcattctttattatccaatgcattagttatatttagtttacttatacatcaatcaaaaataaaatggcaatgtctccatcattatacttgataacaaacagaaggtgagcgtttcagcatgagttttctcattcaattttttatcggcggcaccgttatggtggccgccgcgtatttaagcaagtcgaaatacttatttttatcaggcgttatcacattgctgccgatcatgtcgttactgaatattcacttgcagctgaaaaatatgagccccgacgatttcagagccgctcaaaaaaacggaatattcggtgccttcggcgcagtgatcttcatcagcagtattttcatcctgacaaactggatcaaaggaggccacgcagtcatcggtgcgtttctcatctatatttgctatatgatcggctgtaaatgcctgttatgaagatacggccacgctgtgtataaaaaaatgcccgtccagaacaataagaacgatctgttcagttgtgagcagtttatatgactgaatgatcatgagttgttataatcaatgtcgaaaaacattccgggaggcgaaataaatggcgagaaaattattcacaccatggaccgttaaagatgtaacgatcaaaaaccgtattgttatggcaccgatgtgtatgtattcctcacatgagaaggacggaaaactgcagccttttcatatggcgcactacatatcgcgtgcaatcggacaggtcggcctgattatcgtggaagcgacagccgttaatcctcaggggcgcatttccgatcaggatttgggcatctggagcgatgatcatatcgaaggttttgccaaactgacggaacaagtgaaagcgcaaggatctaaaatcggcattcagcttgcgcacgccggacgtaaagctgagcttgagggagacatttacgctccgtcagccattccgttcgatgagcagtccaaaacaccggctgaaatgacgacagaacaaattaaagaaaccattcaggaattcaaacaggcagcggcgcgcgcgaaagaagccggctttgacatcattgaacttcatgccgcacacggctacttaatgcacgaatttttgtcccctctgtccaatcaccgtacagacgaatacggaggctcacatgaaaatcgctaccgcttcttaggcgagaccattgaagccgtcaaggaagtctgggacggcccgttatttgtccgtatttctgcatcggattatacagacaaagggctggacattgcggatcatatcggttttgcgaagtggatgaaagaacagggagtcgacctcattgattgcagctcaggcgcactcgttcaagctgatattaacgtcttccccggctaccaagtgagcttcgcggagaaaatccgtgaacaggccgaaattgcaacaggcgccgtcggtttgataacgacgggaacaatggccgaagaaattctgcacaacaaccgcgctgaccttatttttgtcgcgagagaacttctccgcgatccgcactttgcaaggagtgcagcgaagcagctgaatactgaaataccgtcaccggtccaatacgacagagcatggtgatgaagtgacagccggagtttttcgatcccggctgtctctttttttatttttcgagaaacgattgccgaagcttctccgtcttccctatagaaccaattagaggagatgactccaatgaaagcagcatggatggaaaggacatatctgattgacgggtgtccgttttatacgaaacaccgtaaaggcgccggcgaagtgacgatcgtctttgaagccggctacggcacttcttctgaaacatggacatcattactcgctgacatagatgaagaatttggggttttcacatatgacagagccggaatcggcaaaagcggacgaagccgaaacaagagaacggcggaccatatggtacaggaattaagcgctcttcttctgaaggccggcgtcaagcctccttaccttgtcgtctcgcattcatacggcacgattatcagcagactttgggcgagccggaaccgccgggatattctcgggatggtgctgcttgatccggtttctgaggatcaggagacgaaagtgcttccgcttcttcctgaagaaatgaaggccgcctatttgaaacagttcaaattggaaggatcacacgcagaatttttaacgagccttaggcagatccagcatcagcagattcatttcggcgatatgccgctgttgattttatcatcgggagagcgggatgagcgcttaaagcacgctcatgaacaatgggtgaaactgcacagaagcatgcttgatgtctcttatcaaagcggatggattcaggccaaaaacagttctcatgccattcatcacgatgaaccgcacatcgtccaccttgccatttatgatgtttggtgcgcggtgcgccagcaaatgaatgctcctgcctatcaggcggtaaactgatgaaaacaaaagccattgtgcaacggcacaatggcttttgttatcgtgatctatttggtctcacgatgcaaagtatactttttcaaccggggtgaatactttttcatttctaaccggtccggattcgtccgtttgttcttcgtcgtgatataatttctgtcccctgtctctgtacaggccaatgtaacattcacacgcatcattttcaccccttttttaaatcgtaattattacgttttattatatatcatcagaaaaaaatgtcaagcgtctattttttaagaccgctccacagtgacctccatgaagtcaaatgcgatcttactgttttcaaataccgctttcgcctcatgttcgagacgctctatcggcgattcaccctgataccttgcgctgatatgagttaagatcagctgtttggcgcctgctttttttgccgtttgcgcagcctgttctgtcgtcgcgtgataataattatgtgcgagctttgcatcttccttggcaaacgtcgcttcatgaacaagcacatccgcattgcgcgcaagctccgttacccgctctgatgccctcgtatccccggaaaaagcgacgattctcccttttttcggggattccagaaaatcccgcccattaatgattctgccatcgtcaagtgtgaccgtttcgccttttttgagtttctgatagacgggtccgggcgggatattcatttctttcaatctgccggcctgcaatgcgccgggaatatccttttcctgaacccggtagccgaacgcttccacaccgtgaatgacggatgctgcggtaacaatgaagtgctcatcttcaaaaaccgtcccctcttcgatttcatgtacggtaagaggatacgtcagatgagtcgccgtcacgttcaggcttgtttcgataaaggctttaatgccttttggcccgtaaatcgtcagctcttcttcaccgccctgaaatgaacggctccccaacagacccggaagaccgtaaacatggtcgccgtgaaggtgggtgatgaaaatcttttctattttcctcggtttgattgttgtatgtaatatctgatgctgagtggcttctccgcaatcaaacagccatacggaacgcctttcttcaagaagcttcagcgcgacggacgttacgtttctcgtctttgccggcatgccggcccccgtccctaaaaataataattccacaatgcttcctcctagatctttgtactactaaggatacaggatcagactgaaaatgtgaattcacccgggccttctccggcctgattaatttttttccgcaaaccgcaaaaaacaggctgaaatgtttgctttcaatgaattttagatttaaaatgaaggaaatatgcggggttttaaaccatgcttcagataaagtgaggtactctaagtgaaaacaaacgacaaaccaaaagcagtaattgtaatatttggtgccacaggggatttggcaaaacgaaaactttacccatccattcaccgtttatataaaaatggtcaaattggtgaagagtttgcagttgtaggtgttggaagaagaccttggtcaaacgaggacctccgggaaacggttaaaacgtctgtttcttctgccgggcaaaaagacatagacgatttcacatctcatttttattaccatccgtttgatgtaacgaatccgggttcctatcaggagctgaatgtcctgcttgatcagcttgaacatacatatgaaatcccgaacaacagaatgttttacttggcgatggctcctgagtttttcggcacgatcgcaaaatcacttaaaaacgaaggtgtcacagcgacaaatggctggtcccgtctcgtcattgaaaaaccgttcggccatgacctgccgagtgcgaaagagcttaacaaagaaatacgcgaagctttcacggaagatcaaatttaccggatcgaccattatttaggcaaacaaatggttcaaaatatcgaagtcatccggtttgcgaatgcgctgtttgagccgctgtggaataaccgctacatctcaaacatccagattacgtcaagcgaggatctcggcgttgaagaccgcgcgagatattatgaaaaatcaggcgcactccgtgatatggtccaaaaccatattttgcaaatggtcgctctcttggcgatggaaccgccgattaaactgaacacggaagaaatccgcagcgaaaaagtgaaggtgctgagagctctccgccctgtcgctccaaacgaagtgagtgactacttcgtccgcggacaataccaagcgggaacgattgacggaaactctgtaccaagctatacagatgagcataatgtagcaccggattccaatacggaaacattcgtgtccggaaagctgttaatcgataacttccgctgggccggcgttccgttttatatccgaacagggaaacggatgaaagaaaaatcaacgaaaatcgtcgttcaatttaaagacattccgatgaacctttattacggcaatgaaacgaatgtaaatccgaacctgcttgtcatccatattcagccggatgaaggcatcacactatatctgaacgctaaaaaattaggcggagccgctcatgctcagccgattaagctggactactgcagcaactgcagtgatgaaatgaacacaccggaagcctatgaaaaattaatccatgactgtctgctcggtgatgcgacaaactttgcccattgggacgaagtggcgctttcctggaatttcgtcgatgcgatttccgaaacgtgggcagccgacaaaaccctttctccgaattatgaagcagggtcaatgggaccgaaagcttcggacgatcttcttgaaaaagacggtctccactggtggaatatataagaaaaaatttaaaaaccgcggcgccgttcatgacggcccgcggtttttaatatcagaaaagcccccgcaatcaatgcgggggcttcttcattacttcatccattcagtatggaaaatgccttctttatctgtgcgttcatacgtatgcgcgccgaagtaatcacgctgcgcttgaatcaagtttgcaggaagcactgccgtacggtagctgtcgtaatacgcaagtgcgcttgagaacgaaggtaccggcacgccttgggctacggcaagtgaaatcacttggcgaagagcgccttggtagctttctgcaatgtttttgaagtagctgtctaacagcaggttgtcaagctccggttcacggtcatatgcgtctttgatcttttgcaggaacgccgcgcggatgatacagccgccgcggaagatcatcgcgatttcaccgtatttcagatcccagttatattcttcagacgcggctttcatttgagcgaagccttgtgcgtaagaacagattttactcatgaagagcgcttttctgaccgcttcaatcagctcttctttattttcagtgaccggcttaacgtctggtccggacagaaggccgcttgctttcacacgctcttctttcattgcggaaatgaaacgcgcaaaaacagattcagtgataatcggaagcggcacgcctaagtcaagagcgctttggcttgtccatttacccgttcctttttggcctgctttatcaaggatgacgtcaactagcggtttgcccgtttcttcatcttttttagtgaaaatatcagccgtgatttcgatcagatagctgtcaagctctcctttgttccactcagcgaatacttcgtgaagctcttcggcagacaatccgagcacctgtttcaaaatgaaatatgactcagagatcagctgcatatcaccgtattcgataccgttgtgcaccattttcacatagtgtcccgctccgtccgggccgatgtatgtcgtacaagcttccccgtccactttagcagaaatggcttctaaaatcggttttacgagttcgtgcgcttccttttggccgcccggcataatagaaggccctttcagcgctccctcttcaccgcctgatacacccgttccgataaagtgaatgccgctttcggcaagctctttgttccggcgctgtgtatctttatagtatgtatttccgccgtcaatcaaaatatcgtctttttccagatgaggaagaagagattgaatcgtcgcatccgttgcagttcccgctttaaccattaataaaattttacggggtgtttcaagagactggacaaactcctcaatgctgtatgtaccgacaacatttttaccttttgcctcttctaaaaactcttccgttttgctgcttgatctgttgtatacagacacagaaaatccccggctttcgatgttaagagccagatttttacccattaccgcaagaccgataactccgatttgttgttttgacatattctaacgtcccttcttcaaacgtttaaccattttaaaatttaaattaaaataaaatgatatttatactaaagaaattatcatacataaccccttttttcaagttattcaccttttcttttcatcctgaaaaaagtctctgttaaagctcgtgccccttgttttgctttcttctttttttataacggcgccttttctgatcaggttttggccgtacttttcattcagctcgttcatcatctgaaaaatcggctcatcctttgcgtcctccttgaatgaaaacagatcaagctgtttatacgcctgctgtttttcaaccagttccgtcccggtgatgccgagaagccttaccgggttttggttccagtgcttgtcaaacagttccatcgccgcttccatgatgtcttttttctgatcagccggattgctgagggtcatgcttcttgtgaccgttttccaatccgcataccgaatcatgatgaacagccggcaggccatgacctccttacgctggagccgttcgctcacagacagcgcaagccggtcaaacacgcccgttaattcatcccagtcagccgaatcatgcgacagggtggatgagttgccgacgcttttaaattcataaatccgctcgggattgacttctgcaggatggatgccgttcgctttatccttcagcctcgggccgtttatgccgagaagcgttttcagcgcatgttcatctccttttgccaaatcaccgatcgttttgatgccgagcgtttttattttttccgcagttttcgttcctataccgtgcatctcttctatcggaagaggccataagacgtccggcagctctctttttcttaaaatggtgatgccgagcggttttttcatgtcagacgccattttagcgagaaatttattcggggcgatgccgatgcttgacgggagcaaaagctctttttgcagtctcgcctgaatgtctgcggctgtctcatacgccctgtgtctgtgcggtgtgtccgtaatatccatgtatccttcatcaatagaaacaggctcgactaaatccgtatactccctcagaatgctgaacatttcttttgacgaactccgatagcggtcaaaattcggaggcacgacgatgagttccggacagaggcgttttgcccgccacaccggcatggtggtctttacgccccgcgctctcgcttcgtagctgcaggtgacgatgattcctttccgttccttcacgtttccggcaacggcgataggttttcctcttaaagacggatcatacgccatttctacggaggcataaaaactgttcatatcgatatgaaatataattctcccttttccggccactcccggcgcctcctttcctttcatagacaaccttatatatatgtagtaaaataagagctgaatggatgtgataaaatgattcttgagtcaatgaatgactttttatttttagtcgattttttcacaattattcttcccgctctgaccgcgatcggcatcgcttttcttttgcgtgagcgccgcgcaggcgagcattggagaacgaaacgaatagatgaacatcaagcagtcgttcagctgaaccgaacagactttcttattattatatatcatcgcattacaacttggatacgtaaagtcatccgcatgaattcaccggcgaatgatgatgaagatgtcagcttcctccttttataacggcaagtgaagatataaaggaggaaacataattgtctaaaacatatcaaaagtggatcgtattgggattattttttatcgtactgtgcacaggccgctcggcttttgcggcgacatctcagactcagacgggaggcctcgggaatatcggttttttccacgattacctgatcgagccgttttcggcacttttaaaaggggtggcgggcctgttccacggtgagtacggactgtcgattattctggtgacgattatcgtccggatcgttgtattgcctttgtttgtgaaccaatttaagaaacagcgggtgttccaggaaaaaatggctgtgatcaaaccgcaggtcgacagcattcaggctaaaatgaaacaaacgaaagatgcggaaaaacaaaaagaactgcaaatggaaatgatgaagctttaccgtgagcacaatctgaatccgatggcaatgggatgtcttccgatgctggtgcaattcccgattttgatcggtttttattacgccatccgctcaacgccggaaattgcttcacactcatttctgtggttcagcttagggcattctgatattcttgtatcactgtgcgcgggggccatgtatttcttacaggcttatatttcccaaaaattaaacgagaaatattcaccggctgctcaaaatccggccgcgatgcagtcagcaaaaatcatggtctttattttccctgtcatgatgaccgttttttcgcttaacgtaccggctgcgctgccgctttactggtttacaagcggactgtttttgacagtgcagaacgtacttttacagcagacgcatcataaaaagaaacaggctgcggctcaggcggagcccgccaaatcataatactgaaaccctgccggaacctatccggcagggttttttcttgtatctgcaaagctttaagcctaatatcatgaagaatgaaaaaagcacccaatcaactgggtgcttcgtttttagttggccgctgtttcgataatggcaacgaccatttctgccgttttgacgagctcttcaatcggcattttttcatttttcgtatggatttgttcatagcctactgacaggttgactgtcggaatgccgtggccggcaatgacgtttgcgtcacttccgccgccgcttgtctgaagttcgctcggacggccgatttttgccgccgcttttttcgcgacttccacaacctgatcgccgtcctgatatttgaaacccggatacatgaccgcgatgtccacttccgcgcggcctcccatctcagctgcagcagattcgaaagcttctttcattttctgcacttgcgcttccattttttcaggcactaatgaacgcgcttcagccagaatatcaacctggtcgcagacgatattggtttgcgtgccgccttcgaaacggccgatattagccgttgtttctttatcaatacggccgagcggcattttagagattgcttttgatgcgattgtaatcgcggagatgcctttttccggttctacacccgcatgagccgttttcccgaaaatggttgctctcactttcgcttgtgtcggcgcggctacaataatgttgccgacttttccgtctgaatcaagcgcaaaaccgtatttcgcggtaatgtctgaacgatccattgcttttgccccgactaatcccgattcttctccggccgtgataatgaattcaatggtgccgtgctcgatgttttgttctttcagcactttaatggcttcaaacattgcggcaaggcccgtcttatcatcagcgccgagaatcgtcgtgccgtcggattttacatagccgtcttccacaatcggcttaacgcctttgcccggaacaaccgtgtccatgtgggatgtaaaataaatcgtatccgcatcttttgtgccctttaacgtacagattaagttgccggctccatgccccgtcacttcttttgtatcatcttcttttacgctcaatcctaaatcagtgaatttttgtttgagcaccttgctgatttccgcttcatgttttgtctctgaatcaatttgaacgagttcaagaaattcttcaagcagacgtttttcgtttaccattttcagttccctccgtttaaagcggtatattaccgtgcttttttttcggtctttcctcttccttatgcgcaagcatgtcaaatgcctgaatcaattttttcctcgagtcttccggccggatgatatcatccaccataccgcaggcagccgctttatacggaccggcgttttccttttcgtatatggcttttttttcgcgcttcgttttctccgggtccccagaagcctgtatgtctctgctgtataaaatcgacgccgcgccttccgctcccatcacggcgatttccgcattgggccaggcgaatacaagatctgctccgagccctttcgaattcatggcgacataagcgcctccgtaagcttttctgatgatgagcgtcactttcggcaccgccgcttcggcaaaagcatacagcaattttgctccgtgacggatgattcccgcatgttcctgctgaaggcccggaagaaatcccggaacatcagcgatcgtcaatagcggaatatgaaacgcgtcgcaaaaacggatgaatctcgacgctttgtcagcggcatcaatcgtgaggctccccgccaagtgtttcggctggtttgcgacaacaccgactgtacgccgtccgagtttcagaaaaccgacagcaatgtttttggcaaaatacggctgaatgtcaaaaaacgttccgtcatccgccagctcttttattacctgtaacacatcgtaaggtttcgaactgtccgcgggaacgagggtgtttaataacggtctggcgtcttcctttttaacgggtagtgccgtctgtccgccgtgcgggagataagaaagcagggttttcacagccgaaagtgcctctttttccgttcgtgcggaatagtgggcatttccgcttatcacattatgtattcccgcaccgcctaaactttccgcgtcaatctgttcacccgtcacctgttcaatgactttcggacctgtaataaacatgtgcgacgtatgttccgccataatcacaaaatccgtcaaagcgggtgaataaacagcaccgccggcacacggcccaagaatgacagaaatttgcggaatcactcccgagtaaaggacgttgcgcctaaagatatgaccgtatccatttaatgataccacaccctcttgaattctcgcaccacctgagtcgttcagcccgatgatcgggtttttgtttttcgccgccagatccattaccgccgcgattttttccgcatgcgtctcgccgagcgtcccgccgagtacggtaaagtcatgggcaaacaaatacacgggccgtccgtcaattgtgccgtatccggtaacaacgccgtctcccggagcattctggcacccgggcgtgcggcttttggcaaacggctgcagctctgaaaaactgtcttcgtccaatagatagtcaattctttctcttgccgtcagcttgccttttttgtgctgttttttatttttttccgctccgccgccgtttgttaaaaaggaacgtctttcgtttaagtgtctgatatgatcactcatgttcatcttgagtttctcctttttcaattgtttcacaaagctcaatcaggacgccgttcgcctcttttggagagagaaatgcgatcttcttcccgcccgctccgttttgcggttcatgatgaagcaaggtcatgcggcatgattcaagctccttgatcgtttccttcatatcggcgcagcggaatgccaaatgatgcagcccttcgcctcttttctgtaaaaaagagctgacgggagacgcgtccgacagcggctcaatcagctcaagctttgtgcctcccgcttctaaaaaagcaactctcacattttggccgtttaccagctcgtctcccatatacgtaagcccgagcatccgttcgtaaaatcctctcgcggcttcaatagagctgacggcaatgccgacatgatcaagttttttcatagcgcggccacctgctttcccccataggatatggcttgttcatataagcaaaacacgttaaaatggtagacagtaatcttaaggagtgaaacaatgtctcaaaaatttatgaaaagcgccgtcatcgtcattttgggcgtatttatactttcaaccctcctctcaggcattatgatgtatttgcagtaaaaaagcaggcgcctcattgcaagggggtttcctgcttttttatgagggctttccgctctattgcaatgtcctcgaatgagcggttttcttttgtaatcaatactttcgttccgggagggataatccggaaaatacggatgacatcccggtttttcatacggatgcagccgtttgatacaaaccccccgatcagctcttctctgtttgttccgtgaatgccgtatattctgccgtcggtgcctttcgcatcaaaaccgatccagcggacgccgagcgggttttccggcgcgcctccctctacatttttcttccggtaatacggattgacggctttgaccgttaccgtaaattctccttcaggcgtcaaatcatccgtttttcccgtcgccacctgataaatgccttctattcggttatcctttacaacagcaagcgcatttgtggctttattgacgataatataagggtcacccggcaaagggttcgcgccaagcggccaaagcggagacagcagcaggacggctgacaataaaaaaaatcgcatgggctcccctccttttttcattagaatgaccaatgaaaggaggactcatgcgattgatccatatgttttttacagcttgatgcctttgaaataacttttaatcacgagatattgttccatctcaccgaggaggtggaacaaagccgcccgcgcttcaaactcctcacgcgttgccgggagcggcatttcttcaaattccgttctcatttctgcaagtctttttaaaaatttatgagcggtattgccgggatgaatggcttcccttaattcatggatgaaatgggcgattatttttccctgctccaccgttattgaaatagaggtaatcttcggcagcagccgttcaatgatttcaaattgtttctgcctcatcttaaaataatgatagtagagattttcatggcgcaaaatatgattctgcacgtcccgataggcgaggtttttcgcctcttgaatcatctgatgcgtctccggtatttccttccctgtccaatcttgctcaccagttaacaaataccgttcgatttcggcgaagatgacggaaaagttgtcctcgatttttttcctgtacgctgcgagttttctgtcgaggctcggcatatacagattcattaacagcgcgacgccgatacctacggtgatcagctggaactcattccagataaacgccatcgtaatgccgccggacatatataaatgaagaatgattactgagctggtgacgatcccttcatttatttttaaaacgactgtagtcggaatgaacagcaccagcaatattccgatcgcaaacggataatagccgatcagtccgaaaaagacatatgaaaagacgatcgccaataaacaggcggcaaatcgggcccacgaggcctgaagcgaccgcttttgtgtaatctggatgcacaatatggtgatgattcctgcggatgcgaagttttgcagatgcaacagctgggctaaataaatggccagcgccgttccaagtgcggtctttagtgtccggtaaccgattttaaacattgcttgctccattctgtttgtttctttctcaaaaaaaagaagaagagcattcttcttcttttcttacagttatattttataatattttttctaaaaagtcctgtgctctttttgacttcggagaaagaaaaaattcttccggctgaccgtcttccacgatcgtcccttcatccataaataatacgcggtctgcgacttctttggcaaatcccatttcgtgcgttacgatcaccattgtcatgcccgtctgcgcgagctctttcatcacctcaagaacttctttgaccatttccgggtcaagagccgaggtcggttcatcaaacagcatgatgtcaggattcatggcaagcgcccgcgcgatggcgacccgctgcttctgtccgcctgacaaacggttcggatagtcgttccgtttgtcaagcagcccgactttttcaaggagagcgcacgccttttcctccgcatcctttttagactctttcttcacgctgaccggcgcgtatgtgatattttcaagcaccgttttatgaggaaacagatgaaaatgctgaaataccatgccgatattttcccgcactttcagtttattcgttttagctgcggtgatttcgttttctttaatggcaatcgttccgccgctcggggtttccagcagatttaagcagcgcagaaacgttgatttgccggaaccggaagggccgatgacggcgacgacttccccttcttcgatctgtgttgaaatgtttttcagtacttcatgtttcccgaatgattttgacaggttgtcgaccttaatcattggctttcagcttcctttctacgccttttccgatgaatgctaagatcaaaacgagcacgtaatagattaagcccgccacaataagaggttctaaatagttgtatgttgcggcgccggactggtaggcccgtctcataatatcgccgagaccgattaccgtgacgattgccgattctttcgtcaaggtgattaattcgttaataatagccggagaaatgtttttaaacgcctgcggcagcagcagatctttcatcatttttccgtacggcacgccgagagcgacggcagcctctttttgtcctttgtcaattgcgttgattcccgctctgataatttcagagacgtaagcggctgaattgagcgataatgcggtgaccgccgcccaaaattgatcgatctgaaagccgagaagctgcggcataccgaaatagatgatcatcagctgcagcacaagcggcgtgccgcggaatatcgaagtataaaaatccgcaatccatttcagcggactgatcgtgctgattttaaataagctgagcacgattcctaatacaagaccgatgaccgctgaaacgagcacaatttttaatgtgaccgcaaggccttccaatataaaaggaatttgggggattgtcgctgagaaatccaaattcatacgtgtgatctcctttgtctttattcaagataaaaagctcaacgaaaagttgagcttccttttatttctcgttggtgaaccattttttcttcagtttttcgatttctccgtttttctccatttctttcagcgctttgttaaacttcgctgtcagatcactgtctttgcggaacgcaatcgcggagcccgattcgtctgatttcgcatctgctgacgcaaagccctgcagatcgttatttgaactgaaatagccttgtgctacgatgtcttcgataatcgcggcatcaaaacgcccggatttaatctcttccgttaagtctgagatccggttgcggtcttcgagctgaaaaccgtatttcgaagcgagcttcttgcctttttcctcttgaatggagccgagctgaacaccgacggttttgcctttcagatcattcagggatttaatgctgcttccctttttcgtaacaatcatattgttagcagtataataaatatcagaaaaatcaacttgctttttccgttccggcgtaggtgtcattccagataaaatcatatctacctgcttggacttcaaggctgtaatcaggctgttgaagtccatgtcctgcacctcaacgtcatagccggtctttttgcccagagcttttgccagatcaacgtcaaacccggtgatctgatcgccgtctttatattcaaatggtttatagtcagccgatgtacccataatcagcttattctttccgccctctgagcctgaattgcctgatccgcaggcggacagcgcaaaggtgatacatgcggcagctaataccaacagccatttcttcatgattcatttcccccatatctactgatctcttaaaattgaatatttattcgttaacttgtattttaaacactttttaattgtgatgcaatactatttttgaaaaatatattttcctttctctgtttattatagtcattgtttttccgattagtgacagctgaacgccggtgtataaatatttatatttatacagattccatataaaaaaccccggaagcgctcggctccggggtttttctttcacttatacttcttcacaatattcttcaaatgcttcctgcagttttgtgacgacggccatcggctcatggccttcaatttcatggcgttccaccattttcatgattttcccgtcttttaaaatggcaaatgacggagaggacggcggatagccttcaaagtattctctcgctttggctgtcgcttctttatcctgtccggcaaataccgtcacaagctgatccgggcgtttatcgtaatgtacagaatggtatgcggcaggccgtgcaataccgcctgcgcatccgcacacagagttgaccatgacgagtgtggttccttttttcgaaagcgcttcgtccacttcctcagcggttttcagctctgtatacccggcggccgtgatttcctggcgggcttgacgcacgacatcattcataaataaattaaaatccatattcaactgggacctctcctttttgatcatcttttcttatgatagcaaggaacctcactatcggcaaatgacaccgctcatatccaaattgttttttgttccttttatgtacctgatgtaagtttatgaccttttaaaaacgggaaacttgttaaagagattgtctgaaataaaggagcagtcgtatgagccaacggaaagcagtattaatttataacggaaacgccggtcaaaaacagattgataaaacgctcggcacggtcgtccccattttggcccagtcagctgacgaacttttgattaaaccgaccaaacatcaggacgatgcccgtcagtattgtgaaaacctcgacagttcagttgaccatttatatattttaggcggagacggcactgtgcatcaatgcatcaacagcatcagcaagcttgataacaggcccgctgtcggcattttgccgggaggaacgtgcaacgatttctcacgggcgctcggcatcccgcaaaaccttcaaaaggccgctgaagcgctcgcggccggacataaacggatgattgacgtctgtaaaacggatgacggctattttctgaacttctggggcatcggattgatcaccgaagcatcgagccatatcaatgaaactgaaaaagcatggcttggtaaaatcagctacttcacgagcgccttgcggacgatgacaagtgcgaacccgtttcctgtcaaattgacaattgacggcgaggtgaaagaagacgaagccgtaatggtgcttgtcatgaacgggcattatatcgggacaaacagagttcccctgcctgatgcgagcctccgggacggcttagccgatgtgttaatctgccgcaacacaagccttgccgcgttgcgggagctgatgacgatggagcagggttcgtttgatgatttcaaaggggagctgtcctatattcaggcctccaggattgaaatcgaaaccggacgtgaaatggacgcggatacagatggcgaggtatacggaacaacgccttgtacgatcgaagtgaaaaaacatcatctcactatgcttgttcccgaggattcacaatgaaaataaaaaaactccttttgccgcccgggcaaaaggagtttttttaatagactgaagtattttcgtcaatgttttctaagatttctttgacgcgtccgaggaaacggccgcatacgagcccgtcgagcactctgtgatctaaagacaggcaaagattaaccatatcacgcactgcgatcatcccgttattcatgacaaccggacgtttgacgatagattctacctgaagaatcgccgcctgcggatggttgataatgcccatagattgaactgacccgaaagatcccgtgttattgacggtaaatgtgccgccctgcatatcttccgcggtaagttttccgtttctcacttttttcgcaaggtccgttatttctctggctatgcctttaatcgttttttcatcagcatgcttaataaccggaacaaacagcgaatcttccgtggcaacggcaatggagatgttgatgtctttcttttggacgattttgtctcccgcccacatgctgttcatctgcgggaactctttgagagcctgcgccgccgcttttacaaagaaagcgaaaaatgttaaattgaagccttctttttgtttaaatgagtcttttatgctgtttctgtacgccgtcatgttcgtgacgtcgacttccatcatcgtccaggcgtgcggaatttctgttttgcttttatgcatattggcggcgatggcttttctgacgcctgtaaccggaatttcaatatcaccggctgacagaactggcgccggcgcttgtttttgctgttgtttcggcgcttgttgcgttgtttgaacggcagccggcgccggtgcttccgacttctgctgcattcccgaatcaatgatcttttgaatgtcttttcgcgtaattcttcctcctgcgcccgttccttcaacttcttcaagctgaatgccgtgttctcccgctaatctgagcacggccggcgaataacgcgctttatttgactggtctttaccttgacggtttgcatcggtgtctgaaggggtattctgctcttcttcccgcttcggcgcctcttcggtttccgtttcttccgtttcaattttgcagatgatctcgccgactgtaagagtctggccttcttctcctacaagttctgtaatcgtaccggtaaaagaagacggcacctccgcattcactttatccgtcatgacctccgcgatggggtcatatttattcacttgatcaccgggggataccagccatttgctgatcgtcccttccgtcacgctctctccgagctgaggcatagccatttgttcaatcgccatgtcaaaaacctccttacgtctttaaaactccgctaattctctcatcgcggcttccgctttgtcaggattcatcatgaagtatttttccattgtcggcgcataaggcattgccggaacatcagggcctgcaagccgcttgatcggcgcgtctaaatcaaataagcagttttcagaaataatggcggcgacctcgctcataataccgccttctttcgtatcttctgtgatcagcaatacttttcccgttttagacgcggcttcaatgatagcctctttatctaacggataaaccgtacgcaagtctaatacgtgcgcggaaattccgtctttttcaagacgctcggcagcctgcagagcgaaatggacgcataatccgtacgtaatgacagtaatgtcgctgccttcgcgttttacatccgcctttccgatcggaaggacgtaatcatcagcagggacttctcctttaatcaggcggtacgccctcttatgttcgaaaaacagcacgggatcttcgtcacggactgcggctttcaacagcccttttgcgtcataaggagttgaaggcatgacaattttaagacccggctggttggcaaaaatggcctccacagattgggaatgatacaacgcgccgtgcacgccgcccccgtaaggcgctctgatgaccatcggacagctccaatcattgtttgaacggtagcgtattttggccgcttctgaaatgatttggttgaccgcaggcagaatgaaatcggcaaactgcatctcggcaatcgggcgcatgccgtacatcgcggcgccgattccgacacccgcaatcgctgattccgcaagcggcgtatccatcacccgctcttctccgaactgttcatagagacccgccgtggctttaaatacgccgccttttctcccgacgtcttccccgaggacaaaaacgcgcggatctctttccatttcttctttcatagctgcattaatactgtcaatataagacattacagacataagtattcctccctacttcgcataaacgtgatcaagcgttgattcaggagatgcgtatggcgctttctccgcttcgtctgtcgcttcgtttacgatagccatgatgtcatccagcatggccttttcttcttcttcacctagaagcccggcttcttgcaagtatgctttgtataaaagaagcggatcctgtttctttgcttcttctacttcttcgcgttctctgtagctgctgtcgtcgtcatcactggaatgcggcgtcaaccggtaggaaaccgtttctattaatgtaggaccttcgcctttagatgcccgttcgcgcgcttctttcacggcccggtaaacttccagcaggtcgtttccgtcaactgtgactcccggcatgccgtagcctgccgcccggtcggaaatattttcgcacgccacctgtttgtcatacggaacggaaatggcatacttattattttcacacatgaaaatgaccggcaatttatacacggcggcaaagtttgccccttcgtgaaaatctccctggttggaagaaccttctccaaaggtaacgaaagagacgatatcctttttatccatgcgtcccgcaagcgcgattccgaccgcgtggggaacctgcgtcgtcacaggggatgagcccgttacgattctgttttccttttgcccgaagtggcccggcatctgccttccgcctgagttcggatcagccgctttcgcaaaacccgacatcatcaaatccttagcagtcataccgaatgcaagcacaacccccatatctctgtagtacggaagcacatagtcggtatcgcggtttagggcataggccgcgcctacttgagccgcttcctgcccttgacatgaaataacgaacggaattttgcccgagcggtttaagagccacattctttcgtcgatttttctggctaacagcatggttctatacatttcaacggcttcttcgtcagaaagccctaatgcttgatggcggtttgtagtcattcaaacccctccttctttccttttaaaaatgaatcgcgtttccgtctgcggctaacgcagcttccccaatcgcttctgaaagcgacggatgcggatgtatggactggccgatttcccaaggcgtcgcgtcgagcaccttggcaagccccgcttcagagatcatatcggtgacgtgcgggccgatcatatgaacaccgagaatatcatctgtattccggtcggcgacgattttgacaaagccatcgctttctccgtatacaagagcctttccgattgccatgaacggaaactttccgatcttaagttcatgtccttttcgggcagcttcttcttctgtcagaccgacactcgccgcttccggatttgaataaatgcatttcggcacaagagcggcatcaagcggagccggattaagacccgccatatgctcaacggcaatgatgccttcacgggaggccacatgcgcaagctgcagaccgccgacgacatcaccgatcgcataaatatgcgattccttcgtctgtccggcttcatttactatgatagaaccgttttccgctgcaatgtccgtgttttcaagaccgatcccttcaatgttcggctggcggccgatggaaacaagcatttgttcggcgtgatacgtttctttttttccattcttttcagcggcaattgaaacgccatccgctttttccaatgtatccggaagcactttcgcacccgttacaatcttaattccttttttcgttaacagtttttccatctcgcttgaaatatcatggtcttcagtcggcaaaatgcggtccgcatattcaatcacagtgatattgacgccgaaatcgttcagcatggatgcccattcaattccgatgacaccgccgccgacgatcaacatggattggggcagacgctcaagctcaagcgcttcatctgatgtcagaatatatgtaccgtctgcttctaaacccggcagcattttcggccttgaaccggttgcgataatcaattgtttcggtatcagcatgtcgttttcttcaccatttgcgtattcgacggaaaccgtaccgggaagaggtgagaagatggaagggccgagcatacgtccgtacccgttgaatacatcaatcttcccctttttcatcaagtgggcgacaccgccggccagccggtcaacgattccctgctttcgtttttgcacgctgtcaaagcggagggagacaccttccgtttcaatgccgaatgctgccgcttcctttgcggttcggtacacttccgcgcttcttaacagcgctttactcgggatacatcctttatgcaggcatgttccgccgagcttttctttttctacaacggccgtttttaagccgagctgggccgctctgatggcggctacataaccgcccgtgccgccgcccagaatgaccacatcatattcagtcgccatttgttttcactccttcgccgatctgatattgctttgactgctcctcgccggctaaaacccgaagcgcgccttgcgcgagagattgcagttcattttctcccgggtacaccagtacatccgaaatccaatctatgtacgatctgatggcggatacgaaacttttcccgtacgccaatccgcccgtcaggacgataatgtctacttttccttttaatacggcgcttgccgccccgatttcttttgctacttgataagccatggcgtcataaatgagcctcgcatgctcatctccggcctgaatgcgtttttccaccttcaccgcgtcagttgtccccaggtagccggagagtccgcccgtgccgacaagttttttcatcatatcggcttttgaatacttgccggaaaaacacatctccaccaaatcacccgcaggaacggttcccgcacgctccgggctgaagggcccttctccgtgaagcccgttgttgacatccgtcacccgtccgcaatcatggaccccgactgtgatgccgccgcccatatgagtgacgatcatcttcatctgttcataccgtttgccgagggacgccgccgcatgacgggcaacagctttttggttcaaagcatgaaaaatgcttttccgcttgatttcaggcattcctgatactttagcgagcggagtcatctcatccaccacgaccggatcgacgatatacgcggggatatttaatccgtctgctatttccctggcaataattccgcccagattagaagcatgctggccgttgtagccgtttttcaaatcagtgatcatggcgtcattcacttcatatgtgccgccctcaatcggtctgagcaggccgcccctggcacaaacggcatcaaactttgaaatgttgatgccctgttcgtgcaaagactcaagaatgcttatttttcgaaattcgtattggtcgataatgccgttaaatgctttcagctcttcttcgggatgccgcagcgtcttttcaaagatacagcgttcattgtgaaagacaccgattttcgttgatgttgagcctggattcagaatgagaatgcgtttttcctgttcgaacattttcatacctccagatcaaattcctatcgtctgcttaatatactttggccgttttgcagaaactggcttcttgaacggcgcatgcgctcaattcgttcctcagccagacggtcggccgctaagtatgtcggaatgccgtcacgcgcggaaatatcgagcacccgctcaatgtttgcatagatgccctcaacctttttcaaagcacgctcagcgttgtagccgtaaagctcatcggccacattgatgacgccgcctgcattgatgacataatccggagcgtacacgattcccatttcatgaatggtatcgccgtgacgtgtttctttcagctggttattggccgcccccgcaatgactttcgccttcagctgtttaatcgtgtcatcgttaatgacggcgccgagagcacacggggcataaatatcgcacgcctgtgagtaaatgtcgccgggatcaacggcgcgggcgccgaagtcctcaacggcacgtttaacagattctttattgatatcggttacgattaaagaagcgccttcttcgtgaaggtggcggcatagattgtaagccacatttcccacgccttgcacggcaattgttttaccttccagtgaatcagtgccaaacgccgctttcgctgcggctttcatccctttgtagacgccgtacgccgtaaccggagacggatttcctgatgaaccgaatgccggagaaattccggttacatagtctgtttcatcatgaatgatgtccatatcttcaacggtggtgccgacgtcttccgccgtaatataccttccgtttaagccttggatgtagcggccgaacgcgcggaacatttcttcatttttatctttgcgcgggtctccgataataacggttttcccgccgcctaagtttaaaccggcagccgcatttttataagtcatgccttttgcgagtctcagtgcatcttcaatcgccgcttcctcactgtcatatgtccacattcttgttccgccgagtgcagggccgagcgtcgtatcatgaatcgcgatgatcgcttttaatccggattgttcatcttggcagaataccaattgttcgtaatcataagtctccatatatttaaaaatttccataggttcgttcctcctactgttcttgtgatgcgcaaatcgcaagcgcaattgaatacagtttattttctgcggtatccgctctgctcgttaatgcaatcggcgcttttgcaccggcgatgacagcagcaacatttgctttcgcaaaataaatcattgacttataaagcatatttccggcctcgattgaaggaaccaagagaatatccgcctggcccgctacgcttccggaaatccctttttgcagcgcagccgcttgggatacggcattatccaaagcaagcggtccgtccgcaatgcagccggtaatctgtcctctattgcacatctggacgatcgcagccgcgttcagcgtcgcctccattttcggattaaccgtttcaatagccgcaaggactgcggctttcggcatagggttccctactgaatgtgcgacatgaaccgcattttgcagaatatgcccgagctcttcaagagacggggcaatgttcagcgctgaatcagtcacatacatcagccggtcatagtccggcacttcaaaaacggctacatgtgataacaccctttttgaacgaagcccttcctggcggtttaaaaccgatttcagaagagttgagctcgggagattccctttcattaaaacgtccgcctcttgttcacgcactgcgcgcactgcttttgccgcagattcttctggtgaatcggcgtggatgatgtcagcattgaacttcggctcatttgccagaagctctttcagctttccgctgtcacccgtcagtaaaaatcgtgccgacaagtgttctgccgccattttgacggcgtggatcacttctttatctgctgcgtgggccactgcaatggtttttgcgttttttgccgcggctttttcaactaggtctctcagcttcattttgtaccacctttcttgtgcgaatccgcttttaacaatgcaagttctgtgccaaatatgcgaaagggtttattccggcttttttcaagaaaacatgcagcggtttgcgctttctctgcaatttattgcatgccgtcatttgcaaggccgtacttgtccattttgtagtacagattccgaatgctgacaccaagcgctttcgccgttttggttcggttgaatttatgcttttcaagcgttttttgaatgatgtgcgcttcaaatttttcaacagcctgagacagcttttccccttctacatccggaaaatcactttgggtgccgtttttgtcattcagctctgattcgaaaacaggcagatgctgctgttcgatccgttccatatgcggctctaaaaatatcattgcccgtccgagaacattttcaagctcccgtacgtttcccggccagctgtaggctgataaagctcgcagcgcgttcggcgtgagcccctttacattgcggccgtaatcctgattgattttttcaatgagccgaatgctcagcgcttcaatatcttctttgcgctgccgaagcggcgggattgagatcggatagcggttaatccggtaatacaggtcttcgcggaacgcgccttccgccatggccttttcgatgttgacgtttgtcgctgcgataattctgacattgacagaaatcgcttttgcgccgccgactctgataatttctttttcctgcagaactctgagcagctttgcctgggtgctttgggtcagctctccgatttcatctaagaaaatgctgccgttattcgcttcctcaaaaagtccttttttgcccccgcgcctcgcgcccgtaaacgcgccttcctcatagccgaaaagctcggattcaagcagggattcagacagggccgcacaattgacccgaatgaatttattgtattttcggtcgctttcattatggatggcgtgggcgaaaagttctttccctgtgccggattctccccgcagcagaatcgtcgccggcgttttcgccccgagcttcgcctgttcaagggcaaccagcatttgttcactcgtgccgataatgtcatcaaacgtgtatttcgcttcaagcgtgcggatgatctggcgcgcccgattcagctcagcagtcagcgttttaatttctgacacgtcgtggatgacgccgacgctgccttttaaaataccatccacaataacgggggcaacatttacgatgacatcctttttattggggccgaccttcatcctcacaccccgcacgggccgccttgtccccaatactttcaggtgcatgctttccccttctgagatatcggtggaagcgggttttccgatgacttcgctttctgacagcccggtcatttttgtatatgctttgttgattaacattccgatgccgttttcatcaacgacggaaatggcctcgtctgacgattgaataatcgcttcaagcatggtgcggatttgttttaagttcgtgacctcttccgccagttcaactgcgtcggtgatgtctttaaacacgcataacgcgccgagaagttttccgccttcatcaatgatcggcagtcttgtcgtgacaatctgcaggtgcttgccgagaagctgcttctggttatattccggctctctcgtttccagaatccgcggcagctttgtgttcggcactacatctttaatttggcggccgatgacatcctcccgttttcggccgaccattttttctgccatctgattaaataaaatgatcgtttcgttgacgtctataaaaatcatgccgtcgtgcgttgaattaaaaatccggtcatgcttatacgtctgcgacttcagcatttggataagctgctgtttttcctccatcagctgaaacaccatgtacgccaattttcccggcatgacgatggtttgttcttttttctcatggagcagctcatccatgaccgctttatcgcctgttgtatggatgataatatctatatcttcagttatgtagggtttccaatctgatgaggttgcaattccatatctccgggcttcttgcagcccttgcgcctccggatcttgatcaaccaccgcaataatccggatcagttttgttttcatcaaaatctgtaggagcgccgtgcctcctttaccagcacctataatcagcaccttctgcatcccgatacccctttatatgaaaaaatttgcacacctgtatttcccgttgcaataatttgcacaacccctatgttaccacgttttgatctcttgacaaaatattttttcgattggacaataaaggaaatcatatcgtaaaggggttttctgaatatgagccggcttgttgcgcttttgattctggtcctccccggcgctgtcgcggcgctcggcattaaactgatgagagatgcattattcgggcatgcgttttccccgtttccgtccctttttcttcagggggcggccggattggcgttttttttgttcggcctttatgttctggccgggtttattttgtacagagatcggaaacgcaatcaagtcagcccgcggttcaggaaaaaaaagctgtaaaaaaagcccttgcaaaaaagggctttttcagtcgtccggcagtatcgttttggcaatggattgatccagttcttcatagtcatcgtaagcgatcgtttcatataattcttttctcgtctgcatatccgaaagcccctctttttgagagccttcttctttcagaaggcggaaaatacgctcaaaagccttggcagccgttctgagtgacgtgaccgggtaaatgaccatctgacagcccatatcggaaaattcatcagcactgtaatacggcgtttgtccgaattcagtcatatttgcgagaatcggcacactgatttgtttggaaaacgctctgaattcactttcgtattggagcgcttccggaaaaacagcgtcagcacccgcttttatataagcggacgccctttttaatgcccctccagcccttcctgctgtctggcgtctgttctcgcaacaacaagaagagtcggcgcggcccgcttgaccgcttggattttttgcgccatttcttcaatcggcacgagctgcttcccattcagatgtccgcattttttcggcaggcgctgatcctccatttggacggcggccgcgcgcgcttcatacatttctttcgccgtccgggcggcattcagcacgcctccgaaacccgtgtcaatatcgacaaggacgggcagatcagacgagcggaccagatctttaacccgttcagccatttccgccgacgtgatgatgcctaaatcgggcagccctctgctcgccgtgtaagccgcgcctgataaataaagagccgaaaaacccgttttcttggcaataagagcggccatcgcatcgtgagcgcctggaatctgcaatagatccggcgctgccatcagcgtacggaaccgctctgcaagctcctcttgagacgactgcttgctgacgatccacgtcatgtttgtcaccctcctattttatatgagaaataagtccataaattcactaacgctgagcttctgcattcggccgctatctttacaggcctcttcgattttccgctgctgcttcaatgaaaaatgagtgctgatgtttgctgaaaacttggcaagaatcttcggaacggcttcttttctgcggaaccggtgcccgagcggatattcacattcaatccgtcccgtagccgtgccgtctgtaaaatgcacctgtacggcatttgagatggatcgcttattcgggtctaagtaatcttttgagtacgctttatgttccgtcacctccattttgctccgcaatgtatcaattcgcgggtcagacgccgtttcctcttcataatgatccgccgtgatatctccgaaaagcagcccgattgccgtaatatactggaggcagtgatcccggtcagccggattgtgaagcggcccttttttatcgataatccggattgccgactcatgggtcataatcgtgatcctgtcaatgtcttcgatgcggtctttcacctccggatgaagccggaccgcgcactccgccgctgtctgggcgtggaattcagccggataggatactttaaacaaaacattctccatcacataggacccaagcgggcgggcaagcttcatttcctgccggttaaataatacgtcttgaaatccccacccggatgcggtcagagccgtcgggtaccccatctcacctttttgcgccataagggccaaatatacgcctctgctcgtcgcgtcgccggccgcccatgatttgcgtgatccggtgttcggcgcatgacgatacgttctgaggcttgaattatcaatccaagcgtgagatacggcgttattgatttcctctcttgagccgcccagcatttgtgcgcaaacagccgcagtcgccaccttcacaaacagcacatggtcaagcccgactctgtttaaactgttttccaaagcgagaattccttgaatttcgtgcgctttgatcattgcgcaaagcacatcacgcacggtaagcggttctttcccttctgaaatccgcactctggatatataatccgcacaagccaatatgcctccgagattgtcagacggatgcccccattcggccgcaagccacgtatcattataatcgagccacctgttgatacagccgatattaaaggcagccgtgaccgggtctaaaacaaaaggcgtgcccgggactctgctgccgttgggcacggaggttcccgggacaatcgggccgagcagctttgtacattcgggatagctgagcgccaaaattccgcagcctatcgtatcaagaagcacatgtcctgccgtagtgaaagcttccgaactgtcaatctcctgatggagcacgtagtcagaaatctcttcgattacggcgtccattcggcggggttctgtcatgttttcatcttcctttctcatctgtttacagacgcgctccggtatagcggacacgcgggcggaaaagccggtttcggctgtgctgttcaatgacgtgggcgcacagcccgaccgtccgtgcgctgaagaatataggcgtatacagcgggatcgggatgccgagcatgtaatagaccggcgctgcgtagtaatctaagttcgggtaaaggccttttttctcccgcatgacgatttctcctgcttcacacatatgataaagacggaaatcacctgaaagatcagacagttttttcaacgcttctttcatcatgagcgccctcgggtccatttttttcatgtagacacggtggccgaagcccatgattttttctttgtttgcgagtttttgagttaataattgtgtaaacccgtctgtatccttcgcttcctcaagcatgtacataactgcttcgttcgctccgccgtgaaggtttcccttaagcgaggcgactgctccggtcagagcgccgtaaatatccgattgcgtcgaagcaatgacacgggccgtaaacgttgagttcggcaattcatgctcactgtataaaagaagcgaccggtcgaatatttcttcttccaaggaggacggcgtttttccggtaatcatatataaaaagtttgcgctgtacgacaaggttccgacaggcgctaaaggctccagtccgttgatgactcgatagctgttgacggtcagattgggcattttgcctatcagcccgcggacacggtgccgatttacagaagaggtgcggttatcaatatccttatcaaagcctccaagcgcggacaaacctgtcctcagtccgtccatcgggtgagtacgttcgggcagcagacggcatatacgcaagatttcctcgggaaggtgtccgccgcgccgaacgtcttcttcaagcgccttcttctctttcgcatcaggaagtctgtcttccaataagagatgaacaatgtccatatagccggccgttttagaaagctcaatcagatcgtggcctttgattaaaatactgccctgctgtgtatccaggaaagaaatccccgtttccaccgcaatgacgccatctaaaccgggagaataagattccatagtttcgctcctttgcgcactttttattgaagaagatacttagaaataatcagcctttgaatctcattggttccttcatagatttgcgtgactttcgcatcccgaaataaacgctccgcgggatactctttcatatagccgtagccgccgtgaatctgcacagcctccaccgccgctttcatcgccgcatcggacgcgaattgcttcgccatagatgcttcttttccgcacggaagccctcgctgatacagatcagccgcatgatagaccaataatttggcagcttccgcattcgttgccatgtcagataatttaaatgaaacggcctgattcgaagcgatgggtctgccgaactggctgcgggttttggcgtactccgccgagcagccgagcgccgcttcgataatcccgagcgcctgagccgctatgccgatccgtccgacgtcaaggtttttcatggcgattgaaaaaccctcgccctcttcgccgagccggttttcaatcggaatttccgcttgatcaaactgcaattcggcagtattggaacctaacaatccgagctttttttctttttttccgacagaaaaaccgggtgtgtttttttcaacaataaacgctgaaattccctttctccctttacccggatcggttacggcaaatgtcagatacagatctgccgctccgccgtttgtaataaagatttttgaaccgttcagaatatatgaaccgccttttcgcacggctgttgttttcaggcttcccgcatcagatccggagtgagtctcagtaagcgcaaaagctccaatatattcgcccgctgccagcttcggaatatacgtttgtttttgggcttctgtcccgaaatgcaaaatcgggattgtccctaccgatgtgtggacggacaaaatgacgccgacggccgcgctgacttttgatatttcatgaatcgctaaaatgtaagatgttgtatcagcacccgccccgccgtaagcttccgggacgggaatgcccatcaatcccgcttcgcccatttttttaatcagccgctccggaaattcatctgttgattccatgagctcaaccatcggtgcgatttccttgcgggcaaaatcacgcaccattttcctcatcatgatgtgctcttcagtaaaatgcatggctgccgtctcccctcatgatctttacgtcatctgccgtactcataaaaaccgcgcccgctttttttgccgagccagccggcgctgacatattttctgagcagagggcatgggcggtatttcggatctccgagccccgcgtagagaacctccataatggaaaggcacgtatccagcccgatgaagtcagctaatgttaaaggacccatcggatgacgcatgccgagcttcatcacctcatcaatcgcttcctttgaagctgctccttcgtaaaggcaataaacggcttcgttaatcatcggcattaatatgcgattagatataaagcccgggaagtcattgacttcgacaggggttttattcatccggacggcaagcttctttactgtttccgccgtttcttccgatgtggcgagtcctctgatgacttcgacaagctccatgaccggaaccggattcataaaatgcatgccgattactttttcaggcctttttgtggccgcggcaagctccgtaataggaagagaagacgtattgcttgccaatacggcatgagggggacagattttatcaagtgtgtcaaacaattccgcttttgcttttttgttttcggcaatggcttcaatgataaaatcagcatctcccgcttctgtgagctccgccggggaaatacggctgaaaacggcatctgtctcctgctgtgacttccgtccttttgcctgctctttctccaggtttgtctttatgcggtgaagaccttttgttaccgtttccggctcccaatcgtataacttgacggcaaacccggcttctgcagccgtctgagcgatgcctgcccccatctgaccggcacctgcgaccatgattgttttcatcttcatccggcgctccctcctttgatcagtacacctccagcaggacggcatctccttgagccgctccgctgcatatagccgctatgcctaaccccctccgcgacgctttaattcgtatattaaactcatgacgattctcgctccgcttgcgccgatcgggtggccgaacgcgattgcccctccgtttacattcactttctcccggctgaacccggctattttttcactcacgagcacgacggacgcaaatgcttcatttacttcaaacaaatcaatatcgtcaacggacagtccggtttttttcaagagccggctgatggcctctcccggcgcgcttgccagctcggacgcttccagtccgacggacgcaaagccaagtatcgctgcgagcggcctgacatgctgctttgctgctttttcctctgacatcagcacaaatgctccggccccgtcatttacaccgggagcgtttccggctgtaaccgttccgtcggctgtgaaaatcggcttgagcgctgcgagctgctcaaggcttgtatcaggacgcagcccctcatccgcttcaacgatatgctgtttgccctttttgccggtccaggtgacggggacaatttcttcacgcaatttgcccgcatcagccgcctcagccgcgcgtttctgactcaaaagagcgtaatgatcctgttcatctcgggaaatgccgtactttttggccgcagtgcttccgtggacagccatatgcacctggtcgaacgcacaggtcagcccgtcatgaaccattaaatcctgaaaaaccccgtcccccatcctcacaccccagcggccggccggaatggcgtacggaatgttgctcatgctttccattccgcctgcaatcagcacgtccgcgtctttcgcccggatcatttgatcacagatggtaacggctctgagccctgatgcacagactttattaatggtttcagccggaacagaccacggaagcccggcatatcttgcagcctgccgtgccggaatttgcccggcacccgcctggacgaccatccccatcaccgctccttccgcttcgctttcactgatagcggcgcgcttgattgcttcttttatggcaatgccgccaagctcggatgccttcacctcttttaatgcgccgccgaattttccgaacggcgttcttgccgcactgacgataaccgtttttcccacaattttgcctcactttcaataagataaaagataacgcttacacaaaacgccctgttacaatatatgaaccggctgaccgagttatgagtgcaccgcctttttcccgcccataaaaaaagaagactgtctgaccagtcttctcagctgcggcattcttcttttatagaaacagccagctttggataatctgtaaaaatcgcgtctatccccgctttcatcagccgcttcatatcctcaggacgattgacggtgaacggacggagcgccgcttggtgttttgcaagatgtgtgatcacttcagcgctgaccgccggcgtgccgagcttcggatgataacccgaagcgggaatggcggcaagataacgttcaggccggtacagcacatccattgtcagcaccgcccgttcaatttcaggcgccagggcgtggcacaccgcgagactctcatgattaaatgaagaaaaaataacgcgcttttccagtccgtaatatctgacttttttgatcacttcttcttccattccttcgtaacggaatacactgtttttcagctcaatgtttatcagaaaatcagcacgttcagcaaaacgcagcacatcggacaaaagcggaattctgacacctttaaaagaatctttccattttccggcggcatcggcggttctgattttgtcatacgccgtatctttcacaaatcctttcaaagatgtcgtgcggtcgagggtttcatcgtgaatgaccacgatccggccgtcttttgtcatctgtacatcaagttcgattccgtcagccccgtcctcaatcgcttttttgaatgcgggcatcgtattttcagggcagtcgcccgacgccccccggtgggcaaaaatattcgtcatatgtgtcacctcagatgtttgtcatcggttttctctattataatcgttatgcacatcaggagggcgctatttacacatattttatcattaccgtccgctgtaataggtttcgattccgtttacaacggcgtccgcggcgtgctcttgtccgttatcgcttttcagcttgtccgcatcttgaggatttgtgataaaacctaattcagccagcacactcggcatctttgaatatgtaataacataaaaaggagcttcttttacgcctctgtccctcatccctaaagacgtgacaagctgctgctgaatgtcggaagcaagcctttcgctgtccgctccttcatatgtcgaattaaaatacgtttccgcgcccgatgccgttgatacggctgaattggtatggaggctgacgaataaatcggattggctggcgctcgctttcgccacccgctcgtccaaacgtaaaaaagtatcatcagtccttgaagctacaggttttgcgccttctgtctccaatttggcgatcaccttgtttgacaccgctaaattgatgtttttctcaagcagtccatttccgccggccccgctgtcttctccgccatgtccggcatctatatagatggttttcccttgcaaaggttcggctgcataagcggacggcgcaagcagaagcagagcggcaccgaaggcagcagcgctttttgtcagtaaacccacgtttttttcctccccgttttcacatatctgtttcttttttcagtttctcaagccgtaattgtccgttgctctcttttttataggtgatttgcaccgccgtatgttcaggcagcgactgacattcaaaccgcttagcgaaaggcaccttcacctcttgcctttctccgtcaatttcgaccgcgatcgtatcgtttccggccgcttttataaatgttccttcctgtgtaaatgacggcgccgcatcagcctccgcggtatactcgcagcctgataacagccatgcggtgaagatcagaagtatggcagacttcacacagatcacctcacgttttctcattcggctttatctttgaacagaatggccgatttgtaaagggagcctccattcctccagcgtttttccatctttggaatgaaggctatctgacctgctgtttacctgaacttagaaagaaaacaagctgatcagtctatgaaaaaggttctgtctgaaggccgaatatgcagaatttaacggaaacggacgactttctgttcattttgaaaaaatatcagatcggcaaaaaagagagccgcgtcatgcactctcccgaatagaaacattcatatttattttgagcttttcataaaatgaacgggacaacttaaaagagcagcgtattggcggcaatgatgagaataatcactccgctcagcaccgtgctgaactgtccgacgtgaaaagaaccgatgcgcaatgaagcggctttttttccaagcgagcagccgatccatatggtcagaaagcttccgaccgccgcagtaatggaaatggcagcgggagaaagcccgatcaaccccgcgcttaatccgttggtcagcgcatttgcggatacggccaccccgagaaccaaggattccaatataccgatttctcccgaaccgtcggcatccgctgcctccggattttgcagcagaccggcaaaacggcctttttttcctgacccgccaacacgcgctgtttttctcggcacagccagcagaatgatgcggataccgatgacagataaaataaacgccgccagcaatacaggaagaaagcccggtaaaacggctgaaatccatttgccgaaataaattccgatataactgaatacaaaacagataaaagcgatcatcatatttgacgcatgcgatattttgatttttctgatgccgtatgacatccccactcctaaattatcaatgcttgaggacactgccaaacctaaaatcaataaccaagccatgttcgtttctctccattctttgatgtcttttcaacatgttgtgccgttgaatctacactatcctattcagcagcacagaaaaggtaccttttctgcaaaaattattgattgacgatcatcattccggcggaaacgaggtgacacccttgacagaaaataaaaataagacactgggaccccttttaaaatcactgcttgataagcactcgctctccatgagaaaactcggcgccttaacaaacattgatacggccactatctcccggattatcaacggcaaacagaaggccaatttaaagcatcttcaggaattttcaaaacacctccgcaccccgctggaggaattgcttgaggcgtcaggcatagacatcggccatgaaaaagaagctgcgccgcaagacccgatgcacgcgattcaggatatgctgaatatggccgagatgtttgatcagcctttttcccgggagcaaattgagcgtgaactgaccagatatgaacaatacgccaaaacccagcagggccatcgcctgatttgcgatgagtttcaaaagaaaatggacaatgaagaaagcgtcggcccttttattgaccatttgaaaaacatgcatcatcagtatatggatgaatcaacaccggctgaagaccgcgcgattctcgggagcgcgctgctgtattatattttagcgaccgacgttatcccggattacatgtttccgatcggctacctggatgacgccatcgccgttcaaatcgctttgaaccggctgaaaaaaaagtaaaggcgcttaaaaaagcgccctttttgtgttgaaaaatatgaaacaccgcattacggttttgtcaaaacagagacagccgtcatatgatacatcaacctaacaaaaaggagggtgtcttctatggacagcaacacagttgtggcagtgtgcgctctgttaagtgttgtgattcagatcggaacgatattcgccgcaggaaagtggaaaaaagaataaacaaattgacggttttttcgcacaagcgtatgcttataaataaccatgtaaaagataagaaagaagatatgcatatgaaaaaaatcattctcctcttcgccgccgctgtcatattcagctcgatcggccatcaaatttcaggaggatataaagatcctgaaaaggaacggagaaaaccgtttcattcgtttaaatggttcagccggtcataacctcaggaagaagaacaagcaaaataattgcacacaatgaaaacataagctagaatacggacgagttaaactcctaaggaagaaggcgaaatgatgaagcaaacttataaaccgctgtttgaaccttttacgttcgaaagcggtgtcactataccaaaccgtatttcagtcgcaccgatgacacactattcatcaaatgatgacggaacgatttccgaccgtgaattaagctacattactccccgttcaaaagaaatgggcatggtcattacggcatgtgcaaacgtaacgccggacggcaaagcgtttccaggccagcccggcatctatgatgattctcacattcccggcttgaaaaaactcgctcaggcgatccagtctcaaggagcgaaagccgttgtgcagattcaccacggaggcttggaatgccctcctgaactcgtgccaaacaacgacgtcgtcagtccgagcggctcagaagaagacggcagacaaacgtcccgtgctctcacagaacaagaaattgagcacatcgtgaaagcattcggcgaagcgacacgcagagcgattgaagccggctttgacggtgttgaaattcacggggcaaacgggtacctgattcaccaattttattcaccgaaaacaaaccggcgcacagaccgctggggcggaagcgatgaaaagcgccttgcgttcccgcttgcagtcgttgacgctgtcaaacaggcgattgatacacacgctgaaaatccattcgttctcggctaccgcctgtcaccggaagagccggaaacaccggggcttacaatgaaagaaacattcatgctcgccgacgcgcttgcggaagagaacttggattatctgcatatttcactgatggatgtcaattccaaagcccgccgcggcgcggatacttcacggacccggatggatttattaaacgaacgcgtcggccataaagtgccgctgatggccgtcggttccatctataccgcggacgaagcgcttgccgtattagaaagcggaattccgctggtggctctgggacgtgtcattttgattaaccccgaatgggcggtgctggtcaaagaaggccgcgaacaggaaatcgaaaaagccattcaggcatctgaaattgataaataccgacttcctgaaccgttatgggaaatgattcagaatacaggcggctgggtgccgtttgaaaagtagactaaaaaactgccggatgtccggcagtttttttgattcacaagtttttaccgctttgtttactcctatttctaacacacagcgtacatatagtaaatagattaatagaaaggagaccgtatatgatggctggtttccctattacgattaacagtctttccggaaacggggttgtcaatgtcggcggtgcgttttcgataagtcctttaaccgtatcaaaaaccgtctacggctcaggagggggaaatacaggtatggtcctgcaaatgaatcaatccagcacatctcaatcttcaaactctcaatactctgatcaaaatgtaacgaaaacattatgatatccgtatttccctccctttccggctggcagcagccggattctttttgccgttttgtttaatcttattccatatcacagcgtacatatagttagtagactgtgagagaaaggagaaaaaatagaatgagcggttgcccgattacgataaacaacgtatcaggaaacggagttgtcaatgttggcggcgccatatccatcagtccgctgactgcatcaaaaaccgttttcggtgccggagggggaaatatcggcattgtcattcaaaacaatgctgtaagccagtccaaaatgtttgaacatcaattttcagatcagaatattgtaaagtcattgtaagggccgccatgctgcccttactgcataaataaagcaggcgcatgctttcccgaaaacttgattttaaacatcagcggtcaccttctcatgttttgaatgatttcagttaaagatgaatagaatgcagattgaaagcatgagtactgaatctcattaaggaaagaaggaatcgtgatgaaaaaactttgccgggaagtttggattgaagttgaccttgatgcgataaaaaagaacgtacgggcgatccgccgccatattccgaatacgtctaaaattatggccgtcgtaaaagcgaacgcttatggccacggctctgtggaagtagcgcggcaggcactggaaagcggggcgagcgagcttgctgtcgccagcgtcgaagagggaattgtgttacggagagcgggaattaaagcgcctattcttgtgctcggcttcacagctctcagctgtgtgaaaaaatctgccgtttggaacatcacattatcagcgtttcaggtcagctggatcaaaaaagcgaatcggatattggaaaaagaagcagagtcgaaacggctgtccattcatatcaatgtggataccggaatgggccggctgggtgtgcgcacagaagaagatcttttagcagtggtgaaagcgctcaagtcgagtacatacctgtcatgggatggcatctttacacatttttcaacagcggatgaaccggacactgagctgacgatgctgcagcacgaaaagtttatcagctttctccgctttttaaaaaatcaagacattacgctgcctaccgtgcatatgtgcaatacagccgccgctatcgcattcccggaattcagcgccgacatgatccgtttaggtattgggttatatggtttatatccgtccgcctcgataaaggaactgaacctcgtggatctcacacccgcactaagtttaaaggcgcgtatcgcttatgtgaaagctatggtgacagatccccggaccgtcagttatggcgccacatatatcgccgaaccgggtgaaatcatcgcgacgattccgatcggctatgctgacggttactcccgcgccctgtccaaccgcgggtttattctgcaccgcggcagacgggtgccggtggcggggagagtgacaatggatatgataatggtcagtttaggtgagaatgagggcaaacaaggagaagaagtcgtcatctacggcaaacaacaaggagccgagatttccgttgatgaaattgccgaaatgctcggtacgatcagctacgaagtcctttctgtgttaagccgccgcatcccccgcttttatttcagagacggcaaaatcattaaaatatcagctccggtattatacgtatagacggcagttcccgtatttatgtatagaacaagtaccggcgtgagtggttcccattgttttcgtcagcaaaatctcaaaacgccttctcttccgcgttcatgcacggaatagaaggcgcaaaaagacatttagccaaaggcttgcgttacgaagctttatgctccaatctcagcttgtcagcaaccatcgcgatgaactctgagttggttggttttgcttttgtcatgcttaccgtatatccgaacagtgaagaaatggaatcaatatttcccctgctccatgcgacttcaatggcgtggcggatggcccgttctacacggcttgcggtcgtgttgaattttttggcgatgtcgggataaaggacttttgtgatgctgccgaggagttcaatatcgttatacaccatggaaatggcttcacgcaaataaagatagcctttgatatgggcaggcacaccgatctcatggataatgcttgtaatgctggcatcgagatttttccgcttcggctccggctggctgcggataatgctgctttgcgcagacggcgcacggtgtgtgacactgctgacatttccgcttacctggcggatatggccgacaaggttttccatatcaaacggcttcaggatgaaataggatgcgcctaaatcgacggcttttttcgtaacgtcttcctgaccgaatgccgtcagcatgatgacgttcggctgcttctcaagctctgattcacgcagacgctccaaaaccgcaagtccgtccagatgcggcatgataatgtctaacacgagcacatcgggattcttatctttaaacaaagaaagacattcctgtccgttataagcaacgccgatcacttccatatcatcctgtccctctatatattcactcaacaggcttacaagctctcgattatcatcagcaacacaaactttaattttctccacgtttcttcctccccaatgtattaacaggacgcaacccatttgactgctatatgttacattcgacaaaaccactacttccccttttaaaaaatccatatttaccaataatagtggtatatctttgtttttctagcattttctaggtttttcgactaaaaattaagtttgacaaatcaggaaacgtgaatttgtcgaaaaatcttcatgtcttattttacatgaatcccggaaagaagtgaagaacgcatcacataaaaaaactgccggatcatccggcagtcagcttgctttgtctttcccgtaaacatcaacacccgcttcagacagcatccattcgatatgaacgccatagccgcttgtcggatcattgacaaatacgtgggttacggctccgacgacctttccgttctggatgatcgggcttccgctcatcccctgaacgattccgccggttcttttcagcagtttcggatctgtcactttcaataccattccctttgtcgccgggaatttttgcggcgtggtgctgacgatttcaatatcaaatttctctactttatcgttttcgataaccgtcagcatttgcgcaggtcctttttttacttcatttgacaaagcaatcggaagcgctttgtcggaaatgttgtttttaatcggctgatgcagtgtcccaaaaatgccgaacgggctgttgcggttaatatcgccgatcgttttccgttctgacgaaaaccttgccagtttttcgcctggattgccgccttttcctttttcaatcgatgttacagtagaacggacgatttctccgtcttctacaacaatcggtttttttgtatccatatcagagatgacgtggcccaatgcgccgtatttttttgttttcggttcaaaaaatgtcatggtgccgatgccggctgccgaatcacggatataaaggccgattcgatatttcccctcggcttcgtcctttgtcggaatcagctttgttttgattttttgcttatcgcgtttcaccaataaatccagagattcaccggttttgcccgctttttgaataaacggggcgatgtcgctcattttttcaattttatgtccgttcattttaataatgatgtcgccagattcaatacccgcttgttctcccggagactttttcccatcctttgtcatcacctggtgaaaaccgacgaccaaaacaccgactgaatgcagttttacaccgatggactgtccgcccggaatgaccttcaattcaggaaggacacgcactttcgtttttttaatgggaaatccggcaagatcatatactacttctgacctgccttgtgtttgccctgttatgtttgcatgaccgtgctcttctttcagcgtaaaggcttctgataattcgcccttttcagcgcttattgatgcattgaccggaacggcctgtgtctggttttcaaagacgctcatttctgacggtatcagtaaatattctttaaacggcttaaaaaagcctacacttagtaaagaaacaaggagaattacacctattgctttcctcatgttatcgtgcattcattccttcactctcctcgctcctatcccacaccactttctttttctgctacatctatacttttgccttcctgcgcttgatttataaccggcatacgaagaaaaacattggatacactgttagagaaatggaacaaaaaataagctgcctgtatcagcagcttatcctgtcgtttttacctgtccggcctgttttaaaagctcttgtgcatgccgttttgtcagatcggtcacttcaacacccgcaatcatgcggccgatttccgctaccttatcctgcttggaaagcggcgtgacatgcgttgtcgtccgtccgtctttgaattcttttgcgatcagaaggtgcgtatccgccatagcggcaacctgcggcaggtgtgtaatgcagagcacctgtgaaccggtcgatactttatggattttttccgcgatggcttgggcaacccgcccgcttacaccggtgtccacttcgtcaaagatgatggaggtgacatcctgctgggaagaaaaaatactcttcatcgccagcatcacccttgaaagctcgcctccggaagcgacctttgacagcggttttaaaggctcaccggtgtttgttgaaattaaaaacttcacaaggtcgatccccttttgggtaagctgcacgggctgcccgttaacaaccggtgcttcactggctgacggatcggttttcacgagaaattccgtatcaaacgttgatttgcccatatacagactttgtaattcctgatgaatcgcttccgccagtttcttggcccatgcttttctgatttttgataaattggcggcttctacggccacatctttgccgaccgactccaattccttcttcagggcttcaaggtggctgtcgcggttctcgatttgatcgatttcctcttctattttagagccgtattccaaaatgtcttctaccgtcgctccgtatttgcgcttcagctgtttgatctcatttaaacgggtttcaataaaattcagccgttccgggtcatattccagatcatctaacagattgcgcatttgaaaggttgcatcctccagcagataataggaacttgacacactttcagacagcttttgcagcggttcattgatatccgaaatatcttcaagctgggcagaggccattccgacccagtcaagcccccctgctcgctgcggagcgcattataggcgttttgcaatgattcataaattttttcaaagttggatatctgcttccgctcttcctgaagaagttcgtcttcattcaattcaagcttcgccgactcgatttcttcaagctgaaattgaatcaggtctaaccgatgcgccatttcctgctcgctttctgacagcttcttcacttttttgagcagctccatataacgctcatagccttcatggtaagcctgaagcgcggattcggcctcagcgcccgcaaatttatccaaaagctccaagtgtttgtcgtcctccattaacagctggttatcatgctgtccgtgaatatctaataaaagtctgccgatttcccttaaagccgcaatcgtcactaattttccgttgacacggcagacgctttttcctccggcattgatgtcccttctcatgacaatcatgtcgtcagatgcgtctattccctgctcacggcatacttcaaaaacgggatgaccgctgtccaatagaaacagtccttcaagctcggcctttgtttcaccgtaacggacaaattcggacgagccgcgtccgccgactaatagggaaacggcgtctataataattgacttgccggcccctgtttctcccgtcaggacggtgagcccccgttcaaacgaaatcgtcagttcctctataatggcaaagttttttattgatagttcagctaacaaacagcattccaccttttatctgataattacgctacagcagctccaaaagacggctttgtacgccttccgtatcttcaggcgtcctgcagatgattaagatcgtgtcatctccgcagatcgtgcccatgatttcttcccattcgagattatccatcagagcgccgattgcctgagcattccccggcatcgtttttaatacgatcatatggcttgctgagtcaatttttacgaacgcatccattaatgaacgcttcagttttgacagcggattgaaccgctgatccgccggcaggctgtatttgtaggagccgttgttcgtcggcacctttacgagatgcagctctttaatgtctctggagacagtcgcctgggttaccttatatccttcttctctcagcatgtcaactaagtcatcctgcgtttcaatctcatggcttgtaataagctctctgatttttatatgcctttggccttttgtcatgtaagcacctctgttttcaagctgttcttgtcattatgttaaccgcttcttgataaaaagtacatgatggcagaaaaaaggaataatagccccctattattccggtacatctgtctttttggcttttaatgtctcatgtgcttcgcggacgatacggagaatatcttcttccggcagttcagcgccgtttccgtcttctccgcccattccagatgaagcagaaactcaatattgccgtctccccctgtaatcggtgagaaggacagtcctttcactgtatatccttcagaagcggcaaattgattcatgcggcggagaacgtcagcatgaacgccgggatctctgacaatgcctttttttccgacggattcccgtccggcttcaaattgcggcttcaccagtgcgatacaatcgctccccggtacaagcagcgtttttaaaaccggcagaatgaggcggagtgagatgaaagaaacatcgattgtcgcaaattccggcaaaccctctgtgaaatcggaaggctcggaatagcggaaattcgtccgttccatgacgacgaccctctcgtcctgtctgagcttccaagcaagctgattatagccgacatccactgcgtaggaccgctcagctccgttttggagggcgcaatccgtgaatccccctgtagacgagccgatgtcaatcatcgttttgccttttaccgagacaggaaacacttccaaggctttttcaagttttaatccgcctctgctgacgtatttaagagggtttccttttaccgttaacggaagatcccgggcgattttttcacccggtttgtccaatcggttttcatttgagtatacgatgcccgccataatggcgcgtttcgctttttcccgcgtttccgcaaggcctttttctacaagaagtacatctaatcgttctttttttgctgtcatgatccaattcctttatgtgtcttcggcggcatcagcagttttatccgattcataacctcagccttcgtgagaccgatttcttcaagcagggcggttacgctgccgtgttcaataaaccggtctgggatgcccattctgtcaatcggtgtatgatacatgccgaggtcatgagcgtattcaagaatcgtgctgccgaatccgccttcaagcacagcttcttctatcgttaaaatcggcagaccttcattaagaatggccttcatcatttgtttatcaatcggctttatgaacctcgcattcacgacacgcacggacaggccttctttttgcagttcttcagccgcttccagcgccatttcaatggtcgtaccgaatgttaaaatgaccgcgtcttttccgggacggagcacttcccatgttccgatcggaatggttttcagctctttatccatcttaacgccgagcccgtttccgcgcgggaagcgcatcgcaatcggaccttcctcgtatgaaagggctgtattgaccatatggcggccttcattttcatccttcggcatcattaaaacgaggttcggtatatgccgcaaaaaggcgatgtcaaagacgccttgatgcgtctccccgtcagcgccgaccaaaccggcgcggtcaatgccgataaatacattcgcgttttgacggcagatatcatggacgacctgatcgtacgcccgctgtaaaaaggtcgaataaatcgcaagaaacggcttcataccctgaagcgccattcccgcggccattgtcgccgcatgctgttctgcgattccgacgtcaaacatgcgctcaggaaattctttcgcaaatccttcaagcttagagccgaccggcatagccggtgtaatcgcgacaattctgtcatcctcgcgcgccagctcctgcacggtgccgctgacaagtccgctccatgaaggcgccgcggctttcggcttgacgaaatcacccgtattgattttataaggccccgttccgtgccatgtgccgattgtgtcggtctcagccggtttatagcctttgccctttttcgtaatgacatgcaaaaggacaggacctttcgtttttttggcgtattgcaggttttcaaacagttcgtggtaggaatgaccgtcaacagggcctaaatacgtaaagcccagctcttcaaaaaacatgcctgacacaagcatatattttaagctgtcttttatccgttccgctgtggcggccaattttccgccgacggccgggatgcgcttaaataaatattcaagctcgtcttttacccattgatatttgccggccgtgcgaagccgtcccagcatagaatgaattgccccgacattcggcgcaatgctcatctcattatcattcaggatgacgatcatatcttttttctcatcaccgatatggttcagcgcttcgagcgccattcctccggttaaagcgccgtctccgataatcgggatgatatattctttcgatcctttaatatcacgggcggctgccattcccatcgcgcctgagagcgatgttgagctgtggcctgtttcccatacgtcatgttcgctttcgctgcgcttcgggaaaccgcaaagccctttatattggcgcaaggtttcaaactccttgccgcgcccggttaacagtttatgaacataggactgatgtccgacatcccataaaaatttatctttcggactgtcaaattctttgtgaagcgcaattgtcagctcgacaaccccgaggttcggcccgatatggccgccagaggcagacagcgatgtgatgaggaaattgcggatttcctcactcagctcttccagctgttcaattgacatctttttaagaaatgacgggtcctgtattgataaaagatccaaagcggatcaactcactttcagcatgaatttctgcaaattaaacagtgtctttttgaaaaaagaaaaagactccctttgtattttcatcgaaactgcttacattttaccataggagcggcagccccttcaaatcaggaccgtttttaatgatctctcgccgcgattaaatcacagaggtcatgcagcagttctttctgaagagaaaggccgctgatgatccgtttcgcctcgctgatatgatacgccagcttctctttcgcgccttcaagcgttaaaagcgacggatacgttgacttttcattcgacgtgtctgagccgaccggtttgccgatcttctcctcatgcccttcaatatcaaggatgtcatctctgatttgaaatccgatgccgatatggctgctgaacagacgcagcttttcgacttcatcctccggcgcatctgccaaaatggcgcccgccgtcacagaaaaaccgaggagcttggccgttttccgctcgtggatggattccagctcctcaagcgttatccgcttttgttccgcttccatgtcggcagcctgcccgccgaccattccttccgttcctgccgcgctgatcagctcatcgacgagacggagccgtttttctgctgaaaccgcctcagacacgtgggatgtgatcaatttaaagctttctgtcagaagcccgtctccggccaatacggctgccgcttctccgaagactttatggtttgtgggctttccccggcgcagatcatcatcgtccatgcaaggaagatcatcatggattaaggaatacgtatgaatcatttcgacagcgcatccgaccggaatcccgtctttttcatcttttccgtaagcattcagaacggctaagacgacgagggggcgcagcctctttccgcccgcttccaaagaatacagcatagattttttgaggatttcaggcatcgcaagccgttccgtatacaaagaaagctgctgttcaatcagttttttgcgcgatgctaaaaatgcgtccagtttatttgtcaccttcgtcttcctcctgaacgctgaaaggtgcaagttcgccgttatcttttaaaataaagtccatttgcttttcgacatgctgaagcttttcatggcacatttttgaaagggccatcccttcctgaaaataattaatcgcctgctcaagcggcacgtctccttcttcaagctttgccacaatgccttcaaggcctttcatcgcctcttcaaatgtcagctcttcactttttttggtttctgtcattttcgttcgcctctcttttgcaatacttcacacgtcagaacgccgtctgtcatctttacttcaagcgtatcattttgttccacttgatcaacgcttttgatcagctctttatctttataggccagactgtatcctctctccatcacctgaaggggacttaatgcattcagtttaccaagaaccgtctgaaactgcgaatgaagctgcttcagctggacattcatgcttcgggcgagctgatttgagcgctcctcgtaccgttttttcgcctgtttcagctgggtttcagggtggagcgccgttaatctgtacgtattccgctccagctgcctttgtttcctgtccgtaagccctgtgagctgtgattggaactgctgatacaaaagatcaaactgctgttccttttgggtatacaatcgtttcggaaaacggaacgcgtaggatgactggagcgatagaacccgttcttttttcttgctgatatgctgctgcatcgctcttgtcagccggacttccgccgtttttgtccgttccattaagtccgtcgtatgggggacggcaatttctgccgctcctgtcggcgttgccgcccggatatccgcgacgaaatcactgattgtaaaatccgtttcatgtccgacggctgatataatcggaatggcggaagcaaaaatcgcccgggctacgctttcttcgttaaatgcccacaattcttcgatcgagccccctccccttccgacgatcaggacgtcacacattttttgtgcattggcttcttcaatgcgcttcacaatcgatctgctggcattttcaccttgaaccagcgcgggaagcacaatgactttcacaagggggtatcttcttttgagtgtggtaatgacgtctctgacggctgctcccgtcggtgacgtgacgaccccgatcgtagccggaaaagcggggatggcctgcttatgccggtcatcaaacaacccttcgccggcaagttttttctttaattcttcatatgctaagtagagcgcccccacaccgtccggctgcatttctttcgcgtacagctgatagcttccgctcggttcatagacggaaatgccgcctcttacgatgaccttcattccgtcctcgggcttaaacgcaagcctcgaactttgtctttgaaacatgacggcctgcatgcgggcatgctcatcttttaatgtaaaatagatgtggcctctcgtatgaattttaacattggagagctcacccttaatccaaatgtcttcaagatgagggtccacatcgaattttcgtttaatgtatttggtcagcgcggaaaccgtgacatatgccgcttcactcacatcctgcactcctttcataaaggctttttgccctaaactaagaaaacccgctctggctgaaaggagccttaagaagcgggtatcgtgctcattgtcacactttttgtgactgtctccggttatctatgataacgtacgtctggcagatttaacagtattatgcgcaagcattgtgatggtcatcggacctactccgcccggcaccggcgtaatgaaagatgctttttctttcgcttcatcaaactgaacgtctccgcagagttttccgctttcgagacggttgacgccgacatcaatgacaatggcgccctctttgatttgatcggctttgatgaaattcgctttaccgaccgctaccacaagaatatctgcttttttcgtatgctcagacatatttttcgtacgggaatggcaatatgtgacggtcgcgttttcgttcagcagcagctggccgaccggtttaccgacaatattgcttcgtccgactacaacaacttctttgccggaaagatctacgttcgtctttttcaataactcgacaattccgtgcggcgtgcatggtagaaatgtatcttcgccaagcagcattttcccgacgttgagagggtggaaaccgtcaacatccttatcgggagagatccgctcgattacggctttttcagaaatatgatccggaagcggcagctggacgagaatgccgtggaattccggattttgattatactgatcaatcactgttaaaagctccgcctcggttaagcttgagtcaaagcggtcaagtttaaatttcattcccattgtttcagcggcttttttcttgcctgtcacatatgaaacagaagcgggatcgtctccgattaaaatgaccgccaaaccgggcactacgccttgtgctttcagctcttctacttcttttgccaattgttcgcgtttttctttagccgtttcttttccgtcgatgattgttgcagtcattttctttcctcctatgattcgatatcagttttaatgttagaaagaaccccgtttacgaattttgcagctttatcgtcgccgaaccgttttgccagctcgattgcttcgtttaatgacacgttagcaggaatgtcgtcagtataaaccatttcatacaccgccagacgcaggatcgcgcggtctacgtttgcaatccggtcaagcttccaattgacgagatggccggaaatcatttcatcaagctgaacctgatgttcgatcactccgtacaccagctgttcaaagaaggcatctgttttttcaccatcaagcgcgtgctcaatggcctcgttcggtgcaatatcgctgacatcaatctgaaaaagtgcctgcaaagctttttctctagctgttcttcttttcattttctttctccttcagatccgctttatccgcttgtcgttaagcttaaagagatcataacatatttttttctcaatcgcatgtcgaaatttaggttttttcaccctaatgccgaatattttcacaaaccgtattaatttcattcggatttcacagcatgaagaaactcggctgccgtttgtaagccggctttcttcatgcctgaaatgacgggaaacgtataaaaaaccaaagggctgcccatccccttggtttttatacgctcattacatttcttcgtcgatttcgacttcttgggctttcgtgtcaaattgaatgccgacgatatgaatattgatttcattaatggtcagagacgtcatgtttaataaggtttggcggatattctcctgaacgcttgccgccactttcgggatcgagatcccgaattgaacgacgcaatagacgtcgatggtaatcccgtcatcggctaaatcgacctttacgcctttaccgtgattgattttgccgaagcgttctacgacgccggtggcgaaattgccgcgcatttcagcaactccttcaacttcggaagcggcgatgccggcaatgacttcaatgacctcaggagcaatttcaaccttgcctaaatgagcctcgtcatgatccattttaagcacactgttgtcttccattcaattcacctcccgcaaaaattatgagcccattacatcatatgtttctaaaaactttgtattaaactctccgctgacaaatgtttcgtgttcaagcagtttcagatggaacggaatcgtcgtttcaataccttcaatcacgaattcgctcagcgcgcgtttcatccgtgcgactgcctcatcacgcgttgttccgtatgtgatgactttagcaatcatactgtcatagtacggcgggatcgaatagccgggatatgcggctgaatccacgcgtacgccgagtccgcccggcggcaggtacatgttaattttaccgggtgaaggcatgaagtttttcgcaggattttcagcattgatgcggcattcaatcgcccagccgttaaattcaacgtcttcctgtctgagcgaaagctcctgtccggatgccactttgatctgttctttgatcagatccgttcccgtcaccatttctgtgacagggtgctctacttgaatacgcgtgttcatttccatgaagtagtagcgctgttctctgtagtcataaatgaattctactgtgccggctcccgtgtaaccgacggccttcgctgcttttaccgcagcttcgcccatctgctccctgatttcagaatcaagcgcaggtgacggtgactcttcaagaagtttttgcagacgtctttggatagaacagtcacgctctccgagatggatcgtgtttccgtaattatccgcaagcacctgaatttcaacatggcggaaatcttctatgtacttctcgatgtacacacccggatttccgaatgccgtagcggcttcctgctgggtaatctcaatgcctttgatcagttcttcttctgtgcgtgcgacccggatgccttttccgcctccgcccgcagtggcttttataatcacaggatacccaatttcacctgcaagcgaaaccgcttcttcggtattttttatgattccttttgaaccgggcacaatcggcacaccagccagctgcatcgtgtcgcgcgcgatatcttttgttcccatttttgaaatggcgtcagccgtagggccgacaaacgttacgttcaattcctcgcacagctcggcaaagtcggcgttttcagctaaaaacccgtatcccggatgaatcgcatccgtgccggtcagctttgcgacgctgacgatgttcgttacatttaaatagctttcttttgatgttttcggcccgatacaaaaagcctcatcggccatttggacatgcagggcgtctttatctgcctcagaataaacggctacagtttcaatgcccagctctttgcaggcccggatgattctgacggcgatttctcctcggttggcgatcaatagctttttaatcataatagcaggtctccttactcagcttttacaagaaatagaggttgtccgtattcgaccagctggccgttttcaactaacacttcaacgatttctccttttacttcggcttcaatctcgttaaagagtttcattgcttctacgatacaaacaactgtattttcgctcacttttgaaccttggtttacgtaagggccggcttccggcgatgaagaagcataaaacgttccgaccatcggagacgtaattttgtgcaggttttcgtcttgtttcggcgcttcctgaacaggagcggcttcatgcgcttccggttttgcagcctgcggagcaggtgcgtaagcggcgggaacggcttgagcttgtcccgttacattcactgccggcgcttcattttttttcagtttgaggcttacgccttcgatttcgtaaacgaattcgtcgatggaagattcatcgattctttttatcagttcatgaatttcgttgatttttaacatcagtttccactcctatgtataaaaaatagaaatttatgggttgctactaaaagtacatactatgtttatcttacaggagcgcttgtgtaaattcaacactgatctaaaatgacatcagaaaagcccgcagcgggtgcgggcggtggagatctcttattttgtcggttcaaacgtgacggcgacgtctttcatcgtcttgatttctttttccaccaggtcaatgatagcggaagcttttgcgtttgaatgtttgtcagacatgaccgtaatgttgattttgtctccttcagcatccacgagcgcatctttgtagccttgtgttttaatcagcgtttccagctgtttttccgtcccttcagcattgctcagcgccgtcattttatcgtaggcttcgcttttttcctttgcggtcgcatcatcgcttgaaacaatgctgtttaactgttccctttctttgcttcttgcgtcttcaagttccatgcggtatgcggtaaataagttttcatcagctgtttctgtagcgaccgatccgtctttgtccgatgcttcggctgatgtttctttatcctcttttgcgcctttagaatctttcgttccttttgttccgtcttctttatccgtgccgcttccgttcttatctttcgtttcaggagccggcgttttttcagttgccacttctccgctgcttttttcgcttttcatctgcacggcatttttgctttccggcgacataatataataaacacttaataccacgacgagactgagcattgttaaaagccaaaccgtttgttttttcagcatgatttatgaatcctccttgatttttttaggggcaaccgctacacggtagctcggaacatcaagcacccttgtgacggcatcaatgatggttttttttatttgaacgttgtccactccctgagcgacaacgagtacaccgcggatatcgggctttttcgtctggacgacgaccggggtttcctgatccccgtttcgaatcatgacaatttgttcttcagaggtttgatcggttacgcttcttttgccgccttctttatcggtttcttcggtggtggtgtcttttttcgttttatttttctcaaacactttcaaagatgttgcgtctacgttcacgacaattgatacatcctccacgccgataatcgtttcaaggatttctttcagctggttttcatagtctctttcataatcatcgatcgtgtttttggcgctgctgtctttcgatgccttaaaaacgggtgcgcttttttgcccgcttttgtcttccgttcggccggacatgacggtctgcgccgcttggtccttcccggttttctccggtgaagagaacagctggctcaccagcataaaagatactccgagcacaaacacgaacagaaagtaatgatattttgtcagttttggtttttctccgtctttcgcctgtccgatcatcagctgttttttgagtatggtccatagtccgtttttattcatggccgtttttctccccgccttccatataaaccgtaattttctcactgccgatttcccatatatccgcaagtttttctttgatgtctgcggcctcttttttttcggctgcgccttccggttcgtatttgcggtctgtgcggatgtcgatcggtgcgacggtttgcacggttttttcagaagatggggccatatacacgctgatcgtttttacatcttcttctgaacgaacctgttcttccgctgtaaggcggatgtcgtctattttgtattcgtcatgactgaacatctcctccgctttcttttttagttggacagccatttcttctaaaacatatgcgcggtttgatgcttgtatttcttttttttctgatttgatttgattttttatatcagcggattgagattgctcttgttttgtcaaataatcgaagatgatttccgggtctgttttgaaaagtttgaagatcgggttgagcatgacaatgattaacagcaggctgacaaccatcttggcgtatttttgcatactggagctgggcagcagcatgtcgatgacgatggcgaataagataaacaaaataatgcttgtcagccattctgttaaaaagctcatatccaatgggcctcctttatttcatcatcatggtgaggttgcctgctgtaataatgactgtaatactgaggaaaaacatgagagagacgatggcgagcgccgcgaaaatatacagcacgcttcggctgatgacgccgaggcacgtaatgacgggcccgcctccgagcggctgcagaatagcggccgcgagcttataaataaaagcgagcgagagcactttgatcgccggaaacgcggagatgcagatcaaaattccgactcctaggattcccacggtgttttttaataggagcgatgcgctgatgaccgtatccgtcgcatccgtaaacatccggccgagcacgggaataaaattgcctgtgataaattttgcagtcctgagcgtaatcccgtccgtcacggcagccgaagccccctgtacggagatgacgccgagaaacacggtgagaaatacggcaagcgcgccgatcgcgatatttctgagcagattggcaagctgcgtgactttatattgatccgtcatcgtgctgacgatgcttaaaatcgctgacaggaaaataagcggcatgacaatgttttgaatgagaaggccgctcgtattcatcagaaataaaataacggggtgaaaaaaagctgcggagacggctcccccggaagacgccaaaagcgcgagtaaaagcgggatgagcgcgagaatgaaacttgtcatcgtctggatcgcttcactggcataattgacggcaacatgaaagctgtttaaagcgagaataatcagcaccatgtagacgattgcataagccactttgctgacagtgctctgctgaaacgcattttgcaaaagctgcagaatgacacaaaaaatggtgagaagaatcaaagttcccagaagctttccgtttgcgagcacttcatgaaacaagtatgaaaataaagccttcagccatgcctccggcgagaacgttttttcaccgttaataaagtcgatgatgcttcccttttggctttcaggcagaagaccgccgtattctgtcatgatgtcgtcccaaaactttccgatgccttctgttttcagcgcttcggcctgctttttcgccacttcatcagcggattcttggtgaactgcggtttcctgcgacgcaccgtctgttccggcagcttgtacacattcagtctgaaaaaataagaggatgaacaaaaaagcccccgcccaccgaaagcgcttcattttttgtgcccccctttccattttattgatgatcaagaaggaataagtccgagaatcgtttcaataatgacggtgagtatcggcacggccattaccagtatcaaaatttttccggccagctctattttcgaagcaatcgctccctggcccgcatcctttgtcagctgcgcaccgaattcagcgatgtaggcgatgccgataatttttaaaatggtttccacatagaccatattgacatttgcattgacggctattttttctatcattctgataatgtcgtaaatctgatcgatgagatagagaaagatcacgcagccgctgaagacgacaatcataaacgcgaaagtcggtttctgttcttttacgatcagggagagaaatgtggcgatcaggcctaaacctacaatttgaacaatctcaatctgtaagcccccctatccttggaatagaaacacagctttgatctttttgaacaggtcatcgacaatcgtcgccaccataaataaaatatagataaagccaagcagcgtcacccattgggcgtattctttttttcccatttggtcaagtatggtgtgcagaaacgcaaccacgataccgactccggcgatttgaaaaatgacatttacgtcgactcccattttatgtttgctcccctcatgtttacatcaatagaagaatgagtaacagtccggctaaaaatcctaagcttttcaccattttttcatttttcgcctgcgcccgtccggcatccgcttccgccgcttccaaatgtgtaagcgcaagcttgatatgtttctgctgagaaacacggtcatggagcccgagcgtctctccgaattgcttcagcacatcgtattcgctttttttcatcgccatggagggccagttatgtttcaagctctgttcccaggccgttttggcggaatcgcttccctgctcaagcctcctgctgaaagcttgaaacaatgacgatacaggcttggaaagctgtgcggcgatttgtcccgaagctatgtgcagcggcgtatgcccgaacatgatttccgcttcaagcgattgcagcgccgcgcgcagctgacggatctgtctcggcctttcaatatacattttggcgatctcaaatcccgtccatgtcgtcgctgtcagaatgaacacggcacccaaaagcttcagcatgtcatcacgctttcagcatgcggaacaggtttcccgtcctttccgtacatcctgctgatcgttcccggaccgcggcgtcttgacagttcaacataccggtcaaacacgttttcctcccaaagcattttcagcgacggcctcttgaccaagtctttcatattccatccgtgcgcagagacgataacggatacgcccgcatggagcgcctccagcagcgcttgtgagtcttccattctcccgatttcatccacaattatgacatcaggactcatagaacggatcatcatcatcagcccttccgccttcggacaggcatcaaggacatcgactctgcggccgaaactgtgctggggaatgccccgcaggcagccggcaatttccgaccgttcatctacgatacctgtcttttttgccggaatgcgttttgatccggtgctggaaagccgggccaaatcacgaagcaaggtcgttttccccgtttgcggaggaccgatgatcagcgtgttcagccagttttctttccataagaaaggaatgagcggttctgcgatccccagcttctcccgggcgattcggatattaaaagaagtaatatcccggagtcctttgacggctccgttttcgacgatgactcttccggccagccccacacggtggcctcctctgattgtgatgtatccttttttcagctcttcttccagcgtgtacatactatagttgctgagccggctgaggatcagctgtgcgtcgccggccgtacacacatatgacaaatacaaaggttgtcctttttggatcagttcaaccggcctgtcgacccggattctgatttcttctgtatcccgcctcgcttcttcgggcacggcggagatggcatctctcaataattcagggagaacctctgtaatttcattcaatagagtcccctcctttttaccgattggcttctttaaaatgtatgatccgggacagactttatgacaccccggccctctatttatgcacaccggccaaaatcagcaccacacccgcaaaaatcaatattaattttgcatatgagagctgtccggcaatctgataaatgccgatcgtcattgtgatgataaagatcagagggccgacgattgccaaaatactattcaccacaaccgcttttctgatgtcgtttgtcaaaagcatgataatagcggcagataattcaatgagcgaggacaaaactcgtaaaccggccatcgttaaaacagtagaattgattgaaccgaacaaaaatttcattgcaatcccccaacttcaagcattttgttacactatatgctctagctcacggaagtagtctcactattttcatatagaagaaagattctgaggcagaacgcaaaaaaaagcctgccccgtaaaaggagcagactccgaatttctttaactacgctcttgacacgtaagaaccgtctgatgtatttacaaccagcgtatcgccttcgttcacgaagaacggtacgtttacgacaaggcctgtttccgttttggcaggtttcgtgccgcctgacgccgtgtcgcctttaattcccggctctgtttcaacaactttcagttcaactgtgttcggcagttcaataccgagcgtttcagactgatacatcatgatatgcacagacatattttccagaaggtatttcaattcttcttcgatttggttttcgttcaattcaagctgttcatatgagcttgtatccatgaacacgtgctgatcgccgttggcataaagatactgcatcgtttttgtttcgatttgagctttcgcgactttttcacctgcacggaatgttttctcctgaatagcgcccgtgcgcaggttacgcaatttagaacggacaaatgccgctccttttcccggttttacgtgctgaaagtcaacgacgcgccaaatgccgccgtctacttcaatcgttagtcctgtacgaaaatcgttaactgaaatcatgtttgatgtcctcctatactccgatcacaaaataattaattctttaggggaatgcgtaattgtccggttgccgtcctcagtgatgatgatatcatcttcgattcttgcgcccccgacttccggtatgtatatgcccggctcaaccgttaccgccatgcccggctcaagaacggccgatgacctgaaagacagccccggtgattcatggacttccattccgaacccgtgtcctgtcgaatggccgaaatactgtccgtagccttttgcggtgatatgatccctcgtcagggcatccgcttcttttcccgtcatgccgggtttaatatgcaggacaccaagcgcttgggcatcgtatacgacctgataaatctctttcagtttatcacttggctctccgaccgcgacggtgcgtgtgatatcagaacaatagcctttataataagcgccgaaatcgagcgtgaccaagtctcccttttcaatcaatttgccgcttgccactccgtggggaaggctggatctgactcccgaggcgacgatcatatcaaaggaagagccgtctgctccttgacgtctcatataaaattcaagctcgtttgcaactgaaatctctgagatgcccggtttgataaacgtcagaatatgttcaaacgcatcatccgcaatcttcgcagcttcctctaatatcttaatctcttcacttgacttaatcaagcgcaacttttcaacggaatccgcgacgggaaccatctccgcttcctgcagcaccgcttggtaggatgcatatgttccgtacgtcatgctgttttgctcgaagccgagttttttaatgccgtactcaagaatcgtatccgcagccgtttggattaagcttccgccgtgctcgataatgtcaaaacccttcacttgcgtcttcgcctgctcggtgtaacggaaatccgtgataaatgccgcacgttctttcgatatgaccgcaaggcctgacgaacccgtaaatcccgtcatgtactgcagattggcggagcttgtcaccaacattccgtctatatccagctgaccgaaaagatttcgcaatttctcaagtttcattccctttctcctcctcgccgattcttgactgccgcctgacaacgcgggagcatccctgcccggttttcagcataaaaaatgttcacttctcgtgaacattttaccataccggacagggattatacacttattcacttgttgccgagcgcccttgcaagcttgtctgacgtaagttcattgtagttgaaggaaattgagtagccgacaaacaaaccgtacagaatgtaaaggcaaagcgtcgtcacgattgtatctgatttcaattcagtgacggatttcacatcttcgaaaatcggattgaataagaaaaaaaccgcacaccataaaatgacgccgtacaccatccccggccacatggttttaaaacgcttcaggcagacgaaataaataaacgccccggcaattgaaatgaatccgatgacaacgatgctgaccatcgtgcccagccattgttttttccattctccgatcataaacggctgaagaatcatgttggggctgatctctgaaaaatgaaagacatacccgagatagccgatcaaactccaaaatacaccgccggcaaatccgataccgcaaattctgccggtaaatgaaacaggctgctgatcatcatcctgcttctttttttcttcctgttctgaatgtttttcgcttgtcatcatggcacctccagtcatagactgcccaaaaattgaaaagtcataaaaagctgcgccatattttcattcaatgagtaaaatctaaagaaacggggtatactgcatgtagaaaaagcattgattttccggctgtctaactagaggtttaccgcggtttcctgtacaatagagtgaaaggaaatggttagtaaatcctaagaaaacaggcaggttgataaacaatgtccaaacaaaaaacgccccctgcatacggcgggcaggctgtcgttgaaggggtaatgttcggcggcagaaaaaattatgttaccgccatccgcaggaatgacggaagcattgattttttcaagcttccgagagtgccgaacgccaagctttcggctttaaaaaagattccttttttgcggggaattgtcgccatcattgaggcgagcgccaacggcacaaagcatttaaacttttccagcgaacgttacgggcttgatcctcaggatgacgccaagctggagcaggaagagaagaagggttccggcttatcgatgtttttcagcctggcggtgatcggcgttctgtcgtttttgttcagcaaattcgtttttacgctcgtcccggtcttcttagcggagcttgtaaggcccgtattttcctcagacgccgcgcagatcggaatcgaaagtctgtttaagctgattctgcttctcggctacatttattttttatcaatgacgccgttaattaaaagagtgtttcaatatcatggagccgaacataaggtcataaactgttatgaacagaatttgccaattacaatagaaaatgttcagaaacagtcacggcttcattaccgttgcggttcaagctttattttatttacgatcattgtcggcatgttcgtctatttactcgttccgacagatccgctttgggtgcggattttagacaggattgcgcttataccggtcgttctcggcatctcctttgaagtgctccagctgacgaacagagtacggaatatccccgttttgaaagtgctcggttatcccggcctgtggctgcagcttttaacgacaaaggaaccggcggatgaccaggtcgaggttgccatagaaagctttaacgagcttctcagactggaagacatttcagaacagagcgaaaatccgtctcacaacgtaatctgaaccgttaccgttattattttggaggtgggcagttatgaatcatcgtgtacaacctttttttgctgtattgatagcgcttggcgcattcggtttcatttatgcggcggtaaccaaccccgggcagatgatttcaagagcaatcaccgttattatcgcaggcattattatttattttatcgtgaggacggtcctgaaccgacgcaccggccgtgacggaaccgctttcaaaaaagcggccagacaatcgcggctccgaatgaaggagcaaaaagcgaagcaccgcgccggacacagaggccgggtcagccatttgcggagcgtgccgagcagcagcagaccgaagccgatgattcttaagaaaaaaagccagacccagcttaccgtcatagaaggcaaaaagaataaaaagaaaaacagagcgcttttttaatagctccattgcttcaaaaattgctctgttctgctttttcctagctcaatgagagctagttttttttgcggtgtgagatgaaactccgtcgccatcacatgttccaccggaataaaaataatattctgttcgtactttgtcgcgatatgcctggcatcatgagcgtctttcatcgtttcaaacaaagccccgaacagctcaaaagcgttgcggattgattttttcgggcgctctttttcgttgggcgaaagcgaaattccgatgaccggccgtttgcgttcttttgaatacagccaaatcgggaaattgcttaacacgccgccgtcaacgaccgttgaggtgcctttttcggtcttcagttttatcggttcaaaaaaataaggaatgctgcagctcattctgacggctctggcaaccgggaacatctccggatttaatccgtagcggggaagatcgtcaggaagcacgatcatcgttccgttcgtcagatctgaagcgatgagacggagcgagccttttttcaaatcgccgaacgcgatgatgcccttcgcttttaatttatccgcaatccacttttccagcatatcgcctctgtatagtccgaggcgccaatatatcgacacccactgcaggattttcagcgggaggaatgagtatctctgatcaagcaattgccttccgtccacctcatctatgatggaatgaacctctctgctcgtatagcccgcagcgataaatgcggcaataatcgcgccggcgcttgttccggcgagcctttcaaagcgaaagcccttttcttccagcgcttcataagcgccggcaagcgccaccccttttatccccccgcccgaaaatacgccgtcaatctgcatagcgcgccctctcccttccatctcaaggtgtattattattttaagaaacggctgggcgaaatagaccaaagaatgaagacattaaaaaaagggcgccccatttcgggctgccctttattcaccgggattttcggtttttttctgtacggatttcaattcttttttccggctttcgtcatcttcaaaatactgaacgaggtcgccgatgcggtcaatgctgttccagctcagatgatgttcgattccttcaacatcattgtaaatcttctcttcatcaacaccaatgattcttaaaaactgctcaagcaattcgtgtctgtatacgagccgtttgccgatctttttgccttttgacgtcaatacgagcccgcgatatttttcataaatcaaatactcgtctttatctagtttttgaaccattttcgttacagaggaggggtggactgccaaagcttccgcgatatcagaaacccgtgcatatcctttttcttctatcagcatataaatctgttcaatataatcttccatacttggtgttgtcataagtaaccctcccaaaaagcaccttaactttataaaccattacaagtttacactaacggtcatgaaaaaacaaggatgcttccggtctgtcaagccttatcagcgcttataattccattcatcagacgcgtatttcgtctcagccagctcattgacaaatgcaagctcttcagacgtgagtgtgtaaggctcaagatgaatgttcagcccttcctcaaaaccggctttaaaagcgattctggcctcatccatcgttacccgtttcggcgttaaggcgttgatggctaccgctttgtttttgaaattccgctgcatgcgctcacggactctgtcgctcggatataaaaacagatcaaacagcttatcctcatcaatgtcaagcaggatggaaccgtgctgaagaatgacgcctttttggcgtgtctgtgcgcttccggcaactttccgtccttcgacgaccagctcataccacgaaggggcatcaaagcagacggacgagcgcggatttttcaagctttctttttctttctccgttcgcggaatcgcaaagcaggcatcaagtccaaggtttctgaatccctgcagaataccttctgaaatcacccggtacgcctctgtcaccgtggccggcatttccgggtgatcctctgaaacgattacgctgtatgtcaattctttatcatgcagaacaccccgtccgcctgtcggtcttctgacaaacccgaggccgtgtttatgtactgcgtcaaagttaatttccttcttaatattttgaaaatacccgacagacaaagttgccggattccagccgtaaaaacggatcaccggaggaatttttttttggctgtgccaatataaaagcgcttcatccagcgccatgttaaatgccgggctttcattccctgagtcaataaaccgccatgtttctttttccatacactgaacccttctttatcgttttaataaaaccagtttaacaaactgccttgaaaatgaaaaatatttcgtttcattaaggatgacaatcgcttcatgctttactataatagtatttgtcccaaaacgtccggtaagccttgttttcaggaagcagggttttgattttataagctaaaggagtagaattgcattgtctaatatgattgctttaattattgttgcggcgtttatcgtttatatgatcgtttcgtacttttaccagcagcgtttaatgaaaacacttacggaagaggaattccgcgcgggctacagaaaagcgcagctgattgacgtccgtgaaccgaatgaatttgaaggcggtcatattctcggcgcgcgcaacattccgctgtcacagctgaaacagcgcaaaagtgaaatccgtcctgataaacccgtttatctgtactgccaaaacaatgtccgcagcggacgcgcggcacagacgctccgcaaacacggctgcaaagatatttacaacctgaaaggcggatttaaaaaatggggcggaaaaattaaagcaaaaaactaatcatgaaaaaagagctgtccgttttatacggaagctctttttttataccgtgtcagcggctgacgtcaggtgtacgttcgtattttaaaaccggctttctagccgccttggtttcatccattcttttgacaactgttgtatgcggcgcctcctgaacgatttcaggcgattcctccgcttcccgcgcaatttgaatcatggcatctataaacgcatcaagcgtttccttcgattccgtttccgtcggttcgatcatgatgctttcttcaacattgagaggaaaatacacagtcggcggatgatagccgaaatccaaaagccgtttggcaatatcaagcgttcttacgccgagctttttctgccttcttcccgataacacaaattcatgcttgcaatgacggtcaaacgggagatcataataaggcgcgagtcttctcatcatataatttgcatttaaaaccgcgttttcggtcacagcttttaagccgtcaggccccatggaacggatatacgtgtaggctctgacattaatgccgaagttgccgtaataaggttttacgcgcccgatcgactgcggccggtcatagtcaaaagtcaaacggccctcttttttcgtgagaacgggtttcggcagatacggaatgaattcttttttcactccgactggccctgagcccggtcctcccccgccgtgcggcccggtaaatgttttatgcagattaaggtgaacgacgtcaaatcccatatctcccggtcttgctttacttaaaacggcatttaaattcgctccgtcataataaagctttccgccggcctgatggacgatttcagccatttccgtaatgttttcttcaaataacccgagggtgttcggattcgtcagcatcagcgccgctgtttcttcgtttaccgctcttttcaaatcttcaatgtcaaccagcccgtgctcatttgacttaacggtaatcgtttcaaaaccggcgaccgtggcggatgccggattcgtaccgtgggctgaatcagggacaatcaccttcgtccgtccgaagtctccccgcgcttcgtggtaggcgcggatcatcatcaggccggtccattcgccgtgagcgcccgccgcaggctgtagcgtcacctcgtccatgcccgtaatctcctccaagtgtccgcttaaatcgtataaaagctcaagcgccccctgaaccgtgtcctcgtcctgaagcggatgaatagcggagaaacctgcgaaccgggcaattttttcatttaatttcggattgtatttcatcgtacaggagccgagcggataaaagcctgaatcaactccgtggtttctcttagaaagagcggtataatgccgcataatatcaagctctgatacttccggcagctttgcgtcttcatcgcggatatagtcaccgggaagaaggctttcaagctctgtttccggcacatcaagctccggaaggctgtaaccgacacgcccttcgcgggacatttcaaaaataagcgcctgatcttgattattcatgttgatcccccaatcccgcaataagcgaatcgatctcttctttcgttctcagctctgtgacggcaatcagcatatgctgatccagttccggatacgcaagacctaagtcatatccgccgatgatgccgtcttgcaggagccgccggtttgcttccttgacgggaagattcagcctgacggcaaattcattaaatatcgggccgtcaaatgctacgtgcaagccggctttttccgcttggcgtctcgcgtaatcagctttcaatatattttggcgggccatgtctttgacgccgttttttccgagcgccgtcatcgcgactgaagccgctaaagcattcagcgcctgatttgaacaaatgttagacgtggctttgtctcttctgatatgctgctcgcgcgcctgaagggtgagaacaaaacctcttcgcccgttttcatcctctgtttggccgacaagccggcccggcacctttctcatcagttttttcgttactgcaaaatagccgcagtgcgggccgccgaacgccgcaggtatgccgaaaggctgcgcgtctccgacgacaatatcagctccgtatgccccgggcggtgtcaaaataccgagcgcgagcgggtttgaagaaacaatcagctggctgtttcctttatgtgcgagcggctcaatgtcctttaacggctcgatttgtccgaagaagttcggatactgaacgatcacggcggccgtctcatcacaaacggcatgttccaatgcttcaagatctgtgacgccgtttttcgcgggcacctctacaacctcaatatattggccctttgcgtatgttttcaaaacatcccgtgattccggatgaacggctgcggaaataatgatttttttctttttcgtatgtcccgacgcaagcatcgccgcttccgcaagcgccgttcccccgtcgtacatagaggagtttgcgatatccattcccgttaattcacagatcatcgtttgaaattcaaaaatcgcctgcagctccccttgtgaaatttcaggctgataaggcgtatatgccgtgtaaaactctgatcgggatatcacatgatcgacgatgaccggctggtagtgatcgtacactcctgcgcccagaaaagacgcatatgtaacagcgtccttatttttcgccgcaagctttgtcagctctctcgtcagctccgtttcagattttgcttttttaatttggtagtctttttgaaacctcacatcttccggaatatcggcaaacagttcatcaattgtttctgcgccgatggctttcagcatttcttttttatcctgttctgtcgcgggcaaatatcgatgcttcatatgactctcctttttcagctctgttttggacgtttataaaacggtgtgcggactatcttcgcttttaccgtttttttacggatttccacttctacttccgttccgacttcactgaattccgttttgattaaggcaaggccgatatttttctttaaagtcggagattgcgtgcctgtcgtgacttccccgatcggaacaccgtcttttttcacggcgtacccgtgtctcggaatccctttttcaatcatctcaagtccgaccagctttcgcggggctcctttttctttctgttcacgcaatacagatttcccgaaaaaatcggaatctttcttgtgtttcacggcaaatccgattccggcttcaatcggtgtaatatctttcgtcaattcctgaccgtataaagcaagcttcgcttcaaatctcagcgtatcacgggcgccgaggccgcacggaacgaggccttcatgctctcccgctgcaagtatctccttaaatagatgaaccgcatcttcattgcggcaatataactcaaacccgtcttcaccggtatagcctgttcttgaaagcaggacttggcgtccggcaacgtccgcctcgtcaataaatgcaaacggctttaaggaggacagatcacattcagtcagcttcgcaagaaccgactgagcattcggcccctgaacggcaagcagtgaaatcccgtcagactgattcgtcagcgtgacatctccttccgcatgttctgtcagccaggcgatgtctttttcaatattagacgcgtttatcacgagcagatagcagctctcgcttttctgatagatcagcaaatcatcgaccgtaccgccgtcaggatagcacatggcggtataaagcgcgtttcccggctttaaatcggcaacgtcatttgtcatcattttttgcagaaaagacagggcgtctttaccggatacttcaacttcccccatatgagacacatcaaacaggcccgcttttgtgcggacggcttcatgctcctctttaatagaagaaaattgaaccggcagctcccatcctccaaaatcaatcgtttttccgccgtattctttatacacatcataaagcggtgttcgtttcagcatcatcttcccccttcagtcattggcgcttgtaaaaacatataaaaaaggacagagaaacacctcatgaaaatgaaggtttctctgtcccggcacctgaaagtttactttatgaacatatcataaagacgtcccctttggtggcctgcttcttctaagtgcagacactctccagagttgcgtcgagcaagagttcttttgcctgagagattcactccgcagtttgctccttcggcgcccggacgcccatctttcgtccgagtctctccccttgctgtcattcgctcatatttaccaattttatggacatactaaagcaatatcttttagtgaaatcattacttatatcctaccaccctcatttacgtccggcaacaaaaattatgataaatcagttttttaaaagaaaggcggttttgttacatatgacagcagagatcatatttgatgcaaactggccgggagagttttctgagcggctgaaaacggacggtccctggtcaaattgggagctgtacaaactgtcggctgaagtccagcagacccttgccattcctgaatttgaagggttgagagctcctttatacctgcccgatttcactccgcttccccatcagcttgaggtcgcgcagaaagtcgttgaaaaaatgaacggcaaggcgattttggctgatgaagtggggctcggaaaaacggtggaagcgggcctgattttaaaagaatatatgattcgcgggctggccaaaaaaatcctgattcttgtgccggcatcactcgtttcccagtgggtgaaagagcttcaggagaagtttttaatacccgctgttgaacagaagaaaagctatgtgtgggaacagtgcgatatcgtcgtttcttctattgatacggccaaacgctcccctcacaaagacattgtcctttctattccgtatgatctcgtcattattgacgaggcgcacaagctcaaaaacagcaaaacgaaaaattatgaatttgcgagaagtcttgtgaagaaatactgcctgcttctgacggcgacgccgattcaaaaccggatcgaagaaatcttcaatttagtgtcactgttaaagcccggccatttaggaaatgaaagcggatttcaagaaaccttcaatcagaaggacgggattgacgctcatgagcatttgaaagaactcgtcaataaggtgatgatccgcaacacgcggagcgacaccggccttacatggacgaagcgccacgtggaaacagtgccgatcaccttttcaccgacggaacaggcgctttacgatgacattgccgcactgaaaaacggcacggaaaagcccgcaagcgcattttccattatgacgctgcaaagagagtgctgttcaagcagggaagccgtgtatatgacgctcaaaaaaatgcttgaccaaaaagacaaacaagcgcccgcattcgatgaacagacgatcgctaatttaatggaccgcatcaatcaagtcacgcaaaactcaaaagcgattcaagttgttgacttgatccaaaagattaatgataaagtcattatttttactgaatacagggcgacacagatttacctgcaatggttccttcagcagaacggcataagctccgttccgttcagaggcggatttaaacgcggaaaaaaagactggatgaaggatcttttccgcggcaaagtgcaggtgctgatcgctacagaagccggaggcgaagggatcaacctgcaattctgcaaccatattatcaattatgacctcccgtggaacccgatgcggcttgaacaaagaatcggaaggattcacagactcggtcaggaaagagatgtccatatctacaatatggcgacaaaacatacggtggaagagcatatcttaaaacttctgtatgacaaaattcatttatttgaaaatgtcgtcggagaattagatgacattttaacaaaaatcaaagtgagcaattttgaagaccatttgcatgatattttatgccattcgctgacagaggaggaaatgagaatcaaaatggacaatctcacctcttttctgtcgtacggtacggaaaagcccgccagaaaaaaaggctcttaaaaaggaggaagcgcgacatgagacagcaggaggttcaccaatttttactgcgcttttttgaagcgaaccactgcccgattacagaacacgggccgggttttatgacggttcagttgacggtcgagatggacaaacaaattatgaaccgcccgttttattggcattggcgtgaaaaaacgggcggcgaaccgaacccgatgaagattacgttcatcactgataaagaaacggctccggaggatatggacggcgagtttatttactttggagccccgcgcctctttcaaatctttcaagcagttaaacaaaatgggagatttacaagaatatatgagaaaattgtatcagccggagccagagtgccgcttcagccctggcttggattaaatgtagtgatttcataccaatccgacatgaaaaaagacagacttttgtctttaggcctgcatcttgtttctggaacaattatagaagggtttcagcagaagcttgcaccgcttccgctgacctcgcaaatatcagactattgctttaccatatcgccgatgattaagccggaaagcgggattaaaaggatggagcattacttaaaagacgctgccgccaaagagccgtcagactgggctgacagcgcgatcgccagatggaaaaaggacctcaggctgctcgatcagttttatgagcagacagaagaaaaacctgaggaataccatttggaaaaacaagcgctgaaagccttatatcagccgaaaattcacattcagattgaaaacggcggtttatttttcctgcaaagtaatttttctggataagcgttatccattcgacacctttcccgttttttctggaaattctatattataataaaagtatatagaaaaaatttctggcgtttcgcatgcgatgaatcacttccagacatgtaaagataaggtcatgggcggattggctgaaatacataaacaagtattttaggaggagaaaatgcatgaaaaatgcaaaaatggaattttcgcaattagataaggaatgggttgagctgatattagaagcccaaaaagcaaatatcagcctagaagaaatacgcaaatacctgctttcgcataaaaagtcttctcaacatatccaggcagccagaagtcataccgtaaatcctttctgaatgtgctataatatcacaaggaaggtgatgacattgattggccagcgtattaaacaataccgaaaagaaaaaggctactcactatcagaactagctgaaaaagctggggtagcgaagtcttatttaagctcaatagaacgaaatttacagacgaacccctccattcaatttctcgaaaaagtctccgctgttctggacgtctcggttcatactttacttgatgaaaaacatgaaaccgaatacgatggtcaattagatagtgaatgggagaaattagttcgcgatgcgatgacatccggggtatcaaaaaaacaatttcgtgaatttttagattatcaaaaatggagaaaagcgcaaaaagaggagtagtgccgccatatgtgcacaactcctcttttaactgtccgactttcggattagtttttatcctcactgtgagccttttcattttctttgacgtaaccgtctttatccgtatgatctttcttaatggtcaagccgttccattgcgtggcttcaaaagagaattgaagagaaatcgcattgccttggaacttgttttgcacacttaatccgtccgcagtttttgcggtgtcatttttaaattggatttccattctcacctggtcataatcagcaggcgttttcggaactccgtcgtactcaggagctgttttgccgttaatggttgccacattgacttttccgctctcgctcaggaatttcggatcaatgtgcttgctgatcgcttcggcagctgctttatcctgctttgttgacattaagtataagtctttcaggctggccgcctttaaaatgatatttttaggatagccgttgcccccttctttaccgactgtcagaaccgtaatttcaaactggctgaggaaatcctccgcagattcattgcctttctttgctcctttaaagtcagtaaaattcaaagccatcagcacttctttaatggcaagtgaaccgttgtttctgaattcaaaatctttcgtcaatttatcacctggttttaagtttgacaaattgacattggctgattgttctttagccgataaatcaagtgttcctgacgcaaatgtagcgtccgtcgacttcacatcattaaatgcggcccatgtgcctcctcctactaatgctaaaccgagtgcggcagaggcaacgcccaagcttaatttctttttcatacccatgtttgtactccccttactttttattttttgttatcaaatcctgtcgccaggttgcaaccgtattcatgtggagatggttctctttttcgcatgttcttccagcgctttcgttttccgctcaatatcgcggagggcgctgacgatgactgttattgagtaaatcaaaagcatgacgccgggaacgattaacagaatcgccgttccgatcggctggcttgccaaatgtatgacatatcccgcatacggaagctgatatcccgtatactgggccgccactttttcagcttgaacgggggcggcatccggggcggcattatggtccccttttgtctcaaacagcaggttcccgtccttttttgtgatcccgattattctgtgtgtgacggctgttccgtcatcttgcgtaaaggtgatcacatcccctttttttaagtcatttacgtcagaaattttctttaccgctatgagcgaacccgtcttaaattccgggtccattgaacccgacagcacggatttcagcgtatagccgaagatggccggctcacccccggaagcccgggtcgaaatcaccgttaacgtcagcacaataatcaggctgaagatgacggcatacaaaatattactgatcagtttcagcgtttttttcatgttcttccccgctttcttttaccggctcagccggctctttctccgttttcttcagatcggaaacggttgcctgttcccggcatttgacgagtttcatcggttttgaccactcaaattgttcttcgtccgccggatacccttcaggcttgtaaatcttgaatgcgtatatgcccggctgcaaagaccgctttgactcaattttataaatcgttttgctttttttatcagtaataagccctttatccacaacattgccgtttcgtaaaggctgctgctgagaagtgattttatggagctcccatttccagtcagaaacagtccgctcttttcccttattctccagctcggcatagagttgaagcggcgcacacacggtgcctgacgtatcagtttgatttgttatatgtaaatcactctgatcccagcgttcgtcataacggcaatcgtcatccgtatattgaaaatctccgcacgtttgaaccgggagactgaagcttttcacatcattgaaggaggaacttgtatcacctgtgaactgagcacatatcgtcacggacaggcaaaaaatgaacgaaagccgtaaaaatagcatcatccgccatctcaccttgccctttttttccattcgcaacaatcggaacatgccttaccccctgtaaaactgttaataaatatgacaaccgttctctttaaagaacttcatgaacaaagtataatcaaggattatcgtcttgaaaaatgtcaaaatcggtcaatttgttcgtttttgagaatggtatctttcaaaaacatcgttttgcttcaaattacacacctttttggaattttttctaataaaacgtgagaaaataacgaggtgcctagcacaaaatggaaagtatatacagcgaaaggacgaagaatgatgatcacacaaagtctgatttgcctttctcttcttgttttcggggtttcaggaacagctcaggcggaaacggtgccttattatgctgttcaccataaatcaaaatgggaaaagttagcagaaaaagaagctaaaaaaagatatccgctcgcccaaacgttatttattcaaaaggtgtgggaccggaaaagaacggacgaagcagtcaaacaataccacttgacattgcgggatggcgcaaaagaatttggtgtgtttgttacgatttcttttaatccctacagccaaaaggtaaataaaattgccgtcattgaggaataccaataaggccctcctgatacaggaggaccttatgtgtgattcgctttattttttccgctgcatccacagcttaaaactgtacggcaatattccgaaccagtgctgagaagccggcactttcttttctttccgcacttcttttcgctctctccgttcctgtttcggcgtatcgaaatatttaacgaattgctcagtcatatattttacataatcatttgttttcacggctctcacctcatagtgctgtctttactatgaagtgttgtcccgccgcctcttttttatacttccgtccattgaatcagctgtttcttcttctgatcgaacaaaaggtgagcctcccgtctcgtgcctgacactgtttcggcctgaattgtaacctgaaccgtttcccggcgattactcccggtgatgcggaaggaaacagttccgtacggaaaacgctgtgtaccagtttggaccttttgtccctgtgtcatatggcggcttgacagcagcgcgccgttttggagcagattctctccgatccagtactccccggcctctttcgcaaatgtttttcgggtgatgaaatcagatgaagtatagctgatgacaagtaaaactgcggcagaaacaaacagaaccgcgggatagataaaaccgtcagatttgtacatttaatcaccttttaaagagctgtaaaccggaatgaccgcctgattctttttacctgtaacgcttgagatctctaataagagcaggccgtttttcacatcagccgttaatgatgccgcgttttgcaggatcggcacgtggccttttccgtttactcttttccttatcatcttatgataaatttcaaaacgcacttcttcgccccctgttttccggcatgctaacgccaatccgccgtccgccggcttcacagtctcagcctgtttacattcgttcatgatctgctgaacggcaatttgatgctcccggctgtctaatccgccgttatcggtccggtttgataaaaacagatgtaaaatcgggcccagggtgcctgataggaaaagacagactgccaaggagaacaaaacattaagaagcgtaaagccagtctgttttgagaatgctgaggcacatttctttttcgccgcggtcagccgcacacactttgtaatactcaccatcccccttccacttcacaccgggagacggcggcttttttccggtcatcatataagtgctgatatgtttctgaagaagctgatacgcttcctggcgatcttctattttcagaccatctgtcagcatgcctgtccagaccggaatgatagacgtcataaggaacagccaaatggccattgctgatagtgtttcaatagtagagaaccctttatttccgtttagcatggacatttccgctccctaagtaaactgtgatctcataggtgaacccggcgctcttcaatcgaatctttcctcccgaattcggatggcctttttcgttaaattcaaggctctccggtaaagtcacaagtgtaatgtgaagcgaatcaaaagaacgctcgacaatccttccggctgactgcagtttgtatttatgctctcttggaagaaaagtgatttttgttcttttatgttctgcgatagccgtttcctgcgcaagctgaatatctttttgaagctgttctgttttttgccgcacggcaaggtgggtgcagaccggcggaaccgtcgtgaacaaaaccgtcagcaggacggacgccaggcttaacacaatcaggctttcaagaagggtaaacccgttttctgtccgcctgttattgttcaactgtaacttctccgccactaattaagatctgtttaccattcgggcaggctgtattctttttgatatacccctctgattgtaaatcgttcatatccggcattttaccttcatggtcgatttcgtacgccgtcacttgggctttcaccatattctgcagtccttcacagcctttatgctgaatgctttgattatgttttgtaacgttaggaatggtgattaaaagcagaatggaaacgataaataaaacgatcagcatttcaattaaagtaaacccatcttgatttttcagacgaagcactcccttacatttggttcatcatctggtacatcggcatcagcattgacatgtagacaattaaaatcataccggccacaacaccgtaaatgacaggctggagaatgccggtatacttcgccgcgttttgttcaagacgctccatcataaactggctgtacgtataaagttcgcggtgaagcaggccgtttgcctgtccgtggctgactgcagccgcaagatctttttcataacacggatgcccggaaagagcggattctatggtttctccggctttcagacgtgtaatgagcatctctgcttcttcacgataaaaaggcagaaaagattgttctttaaaagctgttaagctgtcatagatagaaaggccggatttcagaagactgctgagctgtaaagagaaaaagtagctgttaaaaagaacggccgcttttcccaagaggggtattttcacaacaatgagcattttatcttgcggggattttttcttacataagaaccaaacgtacaaaaacaagcagaaagcggcggacagcgccagtgcgcaggcttcatgaaaatgccgaaaaaatgcaaagatgaaagcagtcgcaccggatgtattcatattcattgattgataaatcccagaaaactgcggaataattaaactttgcaggatataaaacatgacacagacggaagaaattaaaaacatcggataccggagcatttttttgatttgattcgtctgcatgagctttctctgtaacaaatcgccgctttgtttcatcgcccccggcaattctccgtgtttctccgcgaaatagcagatagagacggcttctttatgaaaagacagtgcctcaagcacttcgtaaaacgcatcaccttccctcagcctgcggattccgtccgtcagctctgcaagctgacgtttatgcagctggagtttcagcagtctgagcccttcaatcagactgtatcctttttccgtcatttcaccgagccttttcaaaaaagccgcttgatccttcaacggccaggttcgtttaatccgcttcatgatacacccaccgatcgtaattgtcggttgtgacatagccgagcgcgattccttttctgatcagcctgcggagcgtctgatattgaaaattggcgtgctctccctttgcttcctgaaagcattgggtgaggtttttcccgtagagcagttcataaatgcccgcacggcgggtctgcctgtacatccggcagtacacggaacagttttcctctttgcagaacggacatgttaaatcaaccagacgctgagcggcaatggcaatgacggtttgttcaatttctgtcatgttcaccccaaactccagcagcctgtatatggcgcccttagcatctcttgtatgcaggcttgaaagaacgaggtgtcccgtcatggccgcgcggactgcgatttcagccgtttcggcatctctgatttcccctaagatgatcatatcgggatcatgtcttaaaatcgcttttaaaccggcggaatatgtgactccggctttttcattcacctgaacttgcaacacatcctcatctcttgtttctacggggtcttcaagcgtgacaatccgccggttgaaatgccgttttgcatagttgacaagcgagtaaagagtggtcgtttttccagagccggtcgggccggtaaacagaagcaggccgtgtgaatgcttcagaaaggacaatagtgcggcgcccgccccccgaaataaggacagtttatccagagggggaatctgccgcttaggcaaaagcctgatgacaagactttcatcattcattgtcggcaaggttgacattctcaaatgaacggtttccgtcggaagcggcagagacaatgaaccgttttgcggcttacgtctttctcctatatccatggccgataaaaacttgaaatgagaaataagccttacgcattcctctttttttaagactctttttttcacaagagcatggccgatgcgaaaatgaatgaaagcatccttttctctcggcacaatgtgtatatctgaagcccttgccgtataggcctcgtttatgatgttcctgctgtatgtttcaatatttttcacaagacttccctccttccgcacgtattgtaaatcagatacacaaaagccggcaaaggagagattatgcgttttacactgtgtaaaacgcaaaaaaataaaaaataagccccctgacattgatttactgaatgaaatccggaaccattcggccattttcagccatcaaaaaagcaggcgtatgcctgctcttcttagcgtttcttttctttccgcaaatattttttttgatgctccctcaaaatgtcccctgtccagcctttctgccgcaaataaatataaatcagcagggttgatacaataatgagcacgatggaacagatatacgcatatttccaatgaagctccggcatgttatcaaagttcatcccccagagagctccaagcgccgtcatcggtgtaaagagagttgtaaaaatcgtcaaggctttcacaatttcatttcctctttgggaggtaatgacttcctcggcgtgcagcagattgctcagttcctgatcaaactcattgatatatgtaatccctctttccatcttatgatgagctctgaggtaatctttctgcctgtcatttttcggaagaaacgcttcttttaaagccatttccacttttttagcccccagtgtaaggcctttccaaatgaacagctcatggcgcagtttatgcacattttccaagattcctttgctgttgtcatcatgaatctgccatttcagcgtccgctgcttgacttcaaattcatccagtccgatcagataggaattcatcagctctcccagcagaacaaaaaagccttcaatcggattttcacaggtttgaatctgctgtgtggcatgcttttcttttacaccgcgcagcagcgaaaaatcaaaattaatcgtaaaaaagaagtctctcgtaatataaaagtgaaatacggtatggtttttttcatcatctaatccttgatgatagattaaagatccgaaaaccgcttcattattctgatcatttgtatctgagcgcagaaagtttatatgattttcatgttcaaaccacttttcgcattgcggccagtgattgtgatggatcatttttttcgcttccgttttttcatgcggaccgagctggtaccacagccagtccgcacccgaatgtaccttcatctcttgtcatcctccagtatcgctttcttgttttattaccgtaaatgaggcgggctaaaccaggttcgatgtttgagcagctttctacagtggtattattccgaaaaaagggaggtgcaagccttccttcgcggaaggcgttacattgtatatcatcaaactatccgccatcgtactatttatattattaacggcgtgttttgtcgccatagagttttcaatcgttaaagcaaggcgctcccgtattaatcagctcattgaggaagatgtaaaaggagcaaaagcagccaagcatgtcattacacacctcgatgaatatttatcggcgtgccaattgggcatcaccgtcaccgctttggggatcggctggctgggtgaaccgacagtcaaagcaatgcttcagccgttatttttaaagaccggagttcacgaagcggttgcccaagtactgtcattgatcatcgcctttctgctggttacatatgtgaatgtcgtcatcggcgaactcgccccgaaaagttttgctatccaaaaagccgagcggattacacttttgtctgccagaccgatgattttgttttataagttaatgtttccgttcatctggctgctcaatcattccgcccgcctgattacagccatgttcggcttgaagcctgcttccgaacatgaaatggcttatacggaagaggaattgcgggtgctccttgccgaaagctatcgaagcggcatgatcaaaaaaagtgagctgcattacgtaaataacatttttacatttgataagcgcactgccaaagaaattatggtgccccggaatgaaatggtgagcctgccgttagacagcggatcgggacatatgctccgggacattatcaaaacaaataaatatacccggtatcccgtcgtaaaaggagataaagatcatgtagtcggcatcatcaatataaaagaagttttattcagattcctgtcagaaggagcggcgtttacaaaacacgaactcagcccttacattcagccggcgatccatgtgattgagacgattccgatttatcaattgttcgttaaaatgcagcgggaacacgcccatatggccattctcattgatgaatacggcggaaccgcggggttagtaacggcggaagatatcattgaagagatcgtcggcgaaatccgcgacgaatttgatacggacgaaacaccttccgttcaaaagcttgggaagaaccgctatctcctgaacgccaaattgctgatcagtgacgtcaatgatttactcggaacagagattacggctgatcaagtcgatacactggggggctggtttcttactcagcatattgacgcgaagcccgggagcaccattgattttgaaggctacacatttacggtaaaagaaatcgacagccatcatatcatgacgattgaagctgacaaagctgaatagctgagggagaaatccctcccggccattcagctttttatcatcttaatgattcttttacgataaatccgttttttgccagcgccttcgccagactctgctccgttttcacctgagaaaaatcgatgccgagcttcacgacggtctgcgcgatttccggcctgatgcctgagattgtcgtttctatgccgagaagttttgtgctgtcaatcactttgaaaatctgataagcgaccatcgtatccacaatcggcacacctgatatatctaaaaataaataagaaagccggagtgaagaacattggtcaagcaccgattccaaaatcatttttgcccggtaggtatcaatttcgccgacaagcggcaaaattccaataccggcggcaatcggcataatcggcgcgctcagttcgttaatcatttccttttgggcgtttaattgtgtaaccgtcactttataatattcctctgtaaatacttcaatcatatggtcaattgctttgttcagcttctctccccaatggaataccgcattcgccccgggcttctcagacatcgtttcgcagcatgtctgtatacggttccagaccaatctccggaattctttaaagctcgtgacgctttcatagaccggtacttcatggacggcccggtcccttgcgaactgaagcgcccactttgtcagctcctcttctccgccttctttttccgataaaatgccggcaacgatttcaattaacagacggtgctgcatttccgctttctgatcatctgaaggccgccccgattttggtatgagcagccactggcgtgtgatttcacctgattcttcaattaaggttcgagataatgtttcattcaaatgtttcacgggtctcctccattcaaattactttgtatgtataaatcggcgccggacgcacatactgtaattacatccgatgggctatagccaagcggtaaggcaatggactttgactccgtgatcgttggttcgaatccagctagcccagtcccgcaaccgcaaaaaacgaagattagctgataaatttgatcagcggatcttcgtttttctcttatgatacagattgatgtaccgtttttttcttcgtcagcttcatcagttctcccggattgtatccgataacgagcttattgcgatcgatcagaatcggacgccgcagcagtttcggcttctcagtcaaaagcttcagcacttcatttacagtcatttcttcaatgttgaggttgaggtttttaaatgtttggcttctcgtcgccaatatttcatcaattccttcggtcgttaatgataagatctgtttcaattcatcaattgtcggtgtctccctgaatagatgtcgctcttgaaagtcaacattgtgggcttttaaccaatgtttcgtttttcggcatgatgtgcagctcgggtatgaataaaaaataagttctttcatttttaaaaattcctccctcggataatccgtctctttgttaacataagtaccctgaactttttttccctaaacgtatttcaaaaagatttttcggatcttttttagagaacggcataagatataaaacacagggaaagacataaattccacaataaatataatcatgaaaatgtttacattttgagtgccgatctattataataaacttcagatagactctcgggaggggataaggaatgaatcgcatgttccgggtgttaggattttggacggggatatttgcagtcatgttttttctagggggcatgaaagacgcttctcttttgttttttggacagacgatctttttcgtatttctttcttatttgaatctgactgagcggatgtatatttatattttcggagcttacttaaccgtatttttcgccggatttacatactactctatttttattatgacaccgggcggcggaacccactgaacagaaaaagacagaccgattatggtctgtcttttttcatttacagtgaaaaaccattgataaacgggtttcgctcctgctctgtctggatgtccgtttccggcccgtgcccgcttaacacaagtgtatgtccgggaagcgtgagcagtttttgatgaatggaatcaagcaatacgtcctgacttccgccgtgtaaatcagttcggccgatgcctccctgaaagagcacatcacctgaaatcaccagatccgcgtccttcacataataagaaacgcttcccggtgaatgtcccggcgtaaacaatgtctccaaatggaaaggcccgatgtccaaaatgccgtcgccttcgatgagccgttcggcgggccgtgccgttacggcgatgccccgcaatatgcctgatccgtttaaggaagagtcctccagccacttttcttcatttttgtgaaggtatacgggaacatcccatctgtctcttacttcgtcaagtgcgccgatatggtcaaaatgagcgtgcgtcagtaagatggccagcggcttcagattgttttcttttatgtaattgttgattttgtccgcttccccgcccggatcaaaaataagacaggactgatcctcactgacaagaaaatacgcgtttgcctgaatcggcccggccggcattcgtctccatttcactttcatcacctctttatgtatatgcccttattatgaaggttttctgcggaagattcaatgaatgcggccgggaaaacgctatcgacaaacaaaatgaaaacggttaaaatgaaatggaaagattttcaggttccaatgacaaaggaggagcatgatgttacttgttgtaatcttcggccttgtcgcattattagctgtattaggagtcctgcgggctgtcagacagagaaatatcctgggatttttgttagccgccgccacgctgggcgtgtttggctggtttaccgtaatgaccgttgtaaccagcggctatccgactgcacattaaaagcctgtatccaatggatacaggcttattttttattgctgcaaatgtttgctgacacttttgattttgctctccagcgtcgtttctttatcacgtctgtcatcaatgcggatatttgtcgccactctgtgcagccctttttggaacggggcttcgtgaatatcctgaatgactgcgaataagtcgctcagctcaccttcaatcaacgtgttcatcggcgtgagctgaaatttgattttgccggcagctttgtaaccctccaaaattttttgcacatccgctacatactcactgacgctcggtgtttttgttccgatcggaatgattgtgacatctgcaattgccatttggttcaaactcctttttcatttgttatgattggttctgtcatgcccgttttcagtgaaatcagacggtcatacgtaaagccgtataaagcgtattccccgttcggagagatctgaatcggctccatttccgtgtttttgagcaccgtccgctcccgttcgtctcctaagtcaaagctgatcagattgtaagagcggccttcaggcttaaatatgtaaaaccgcttgtgtgtctgatcgtaatcatattccatcggcgcgaagctctcatactttttttggagaggaaagcggtgtgtcacggatgccggcttttggaaaaagaactcgccgtctccgtccgattgatccgttggtctgacggcaatcgtcatgcccgggcgggaatcagcccagatgacgtgatgaagcactcttttttcttttttcgtctgcaagtcataagaatataaaggaccctcttcctccgtttttccttgcttgatatattggaattcatcagtggaggtccaatggacaaaaggggcctgaacgggactcttttttaaaatgccgttgttcatatcggccgtataggctgtgaagtcccatgtttcagtaaaaacggtaatcatcatttgatacgggtcatacggattccaagccgtctccagctcataagagttaaaggctttgtgataaagtcttttcccctgcttgttcataagcacaagctcagtctgaccgctgcttgtcacctgtacgagaatcagctgttttttccggctgatctttacattgacaatattgccctttgtttcatagagccgttcggattttccgctgaaaagatcatatttcatcagctgatgatgtgctgtatacagaattgttctgttatccagccatccttccgttttttccgcttcctttttactgagcggaacgattttctgttctgccgattttgccgaaacgcctgtgtcttgctgctgatgagatggttcacaggccgctaaacacagaacgaatgcggacagcagaacacaaaccaagtatctcatcagccttccctccattcttttctattgtcccatatttgtttatgtaaacaaatgagaaatttcacagatgtctcaaaaaacaagcgacctccacaaaataccttccgtcgcttgataaatatcagcaaactgatgaaaaggcaaagggttttttcccttcccgagctcaatggtatagccctcttttccatactgctgtataaaccaatccctaaaaccggcatggctgtcaatggttttaacgccttgatagcggtttccgcttatcgcttcaaactcccgaatcatctgggatgattgctccggttcacatccttcgtatccccagtaaatctcttctccctgcgtatgaagcgcgatcagccggtcaggtggctgttccgttatcagccggtgcatcgcctgcgcctccggttcagtgagcggcgccgttcctggaaaatcacggtatgaaggggctttcggtttgcgcctttgttcaatatcccaattggatgggaaatgtttatttaaatccacaccgtttatattcgccttccattcgcggaaatccgggcggtgctcatttaattcgttgaggaattcttttttttctgataaatcttcacatccgtaaagtacgagatcaacaccgtcgggatttacgagcggaacgaatgacaatgatgtccggctgaatatatcaagcacagactgcccgaaaacggttttattttcgcataatgccacggaatattctttacaccatttaagcgcgaccgaggtggtgatccattcattggcatgaaatgaggcgtttacatggacttttctttcggccgtatccgcacctattttcagctcataaagcggctttcccaatacggaactgccgattttacggcatgtgacaaacggaaagacatccgttattttctcaatttcttcataaaccgattcggagccgtacaccttttcttccttcacccattgatcagcggaaagaacgctttcacagtgccggatgtatcgcgaaagcccgctcagcgtctcaagcggcggaccctctgactgcccgctcacggcaaagccgggacaaaataattcatcgctttccgccgttttatcagcggctttcaacagtttttcatcaattgaaagcacctttgcaatatctttcatatgctgtttcaattcaggtttgacacgaattcccgccatgttcatcccccttttttaaaaactatatgacaggggagataaaaaaagaaagccgcccgcgatatgggcaggcagactttcttcagcagttttgatgtttgagccattcatttttggcaatccacgccccgccgatgactccggcgtcatttccaagtgccgcaatcgaaatatcggccgcttccgcagaacgcgggaacgcggtgattttgaaggtctcttccacttttgaccgcaggatttcccccgctttagacacgcctccgccgagcacgatttttgtcggattcatggcgcttgccagatttccgagcacgaggcctaaatgttttgcgacataatcgacgacttcaagcgcggtcttatcctgctgtttagccgcttcgaacacgtcacgtgccgtcagatcgcgcacttgtaagagcgaagagtcggaaaccgccgcaagcttttctttcgcgatgcggacgatgccggttgcggacgcaatcgtttcgatgcagccggattttccgcaattgcacggagctcctccttccggaatactgcaaatatgaccgatttctccgccggccccgtttttaccgtgaacgatttctccgttgacgatgatgcctccgccgactccggttccgagcgtcactaaaatgacatctttggccccgtcacctgcacccttccacatttctccgagcgccgcgatattggcatcgttttcaatgacggccggaatacccgtttccgcctcgagatggtctttcagcggatagtttttccaccccatatttgtcgtctcatagaccattcccgtcgtcatttccacaggtccgggcgctcccattccgatccattttacaatccgtttcggcttgttcagttcttccagcttctgatcaagcgctttggcgatcgtgaccgtaattgtgtttccggatttatcggtcggaacttcccatttatgctgaatttcaccgtacatgttgataaaggccagcttgatggttgttccgcccagatcaatccccgcaaaccatgtatcttccataataatctccttttcttattaaaatcctgctgtgttaactgcctctgatccgctccgattctctctgaagaactccggcggctttttgccataaatctctttcaatcacgtttgacaagtacatttcctttaattcatctttcataaagtcaatttcggcttgtctgtcaccgaaataaacaatatgtccgaatgacttaaacagctgctgcacgtcataaaatgaattcatcttcttcaccatttctattcttcttagtataagcgtatttcatcactgatccgggcgtcaagcaaaaaacgattggagaaaatatccttgtattattttcataaattgtatattcacaattgtaaaaaaacactcatttatgcgtttttctgttacaatactttcgtgcccaaaagcacaaaaggattaaagtttgatggggtgttgttttgaaacaagaaaaaaggctgacgttcatctcagccatcagtttatttgtcttgatgttagcagtcattatttcctgcctgtttttctttcatacagagccgcatatgccgctgttcttttgcgtcattattctgtctctggcaggtttgtggctcggtttctcgtgggagagtcttgaaaaaggaattgtcagcggattaaaaaacggggtgcagccgattatcgtgctggctttgatcggtgtgctgatcggcgcctggatgtacagcggcgccattcccaccgtcaccgtttacgctttgtcaattatacagccgagtcagctgcttttgaccgcattattttcctgcatgattatcagcacgcttgtcggctcaagtctgacaactgtcagtacaatcggcgtcgcgctgttaggggtagcaagcgcggcgggagttccgctcgaatggacggcgggagcagttatttgcggagcttgtttcggtgataaaatgtcaccgatgtccgacacgacgaattttgccgccggaatcggcgaaattccgatttttaagcatattcgccatatgatgggcaccaccgttccggcactgctgatcacgatcgttcttttttatattctcggttcatctgtttcaataaatgccgcttcaacgcaaaatattgaggcggtcatttccggaataaaagaggccgtgcacgttacgccttggtcgcttctttcacctctgttagtgatcattttagctgtgagacgggtttccgtgattccggtgcttaccgccggtattatttccgcagggcttctgactgctgtttttattcctgacagcagcattcaaggatttatatccgccctgcaaagcgggacggcgtttaaaaccggcgaccaggctgtggccagcattatcaacagaggcgggctccaatcgatgatgggatcagtctctctgattatgatcgcctttgcgctcggcggcctgatggaaaaaacgggcctgatcgcggcgctgcttcaaggattgataaaaggcgtgcatacgaaaggacgtcttgtcatggcgaccgtcttctcaagtataggcgtaaaccttgcgacaggtgagcagtatttgtcgatcttaattccgggtcaatcttataaacctttatatgacaagctcggcattaagcggattcaccttgcgcggtcgcttgaggacggcggaactttgatcaacccgctgattccctggggagtaagcggcgcttttatggcaagcgcattaggggtttccgtcgtcgactacctgccgtttacctttttcctgtacatttctcctataatctcaattctgctcggtttcctgaaaaaaagctgacaatacgagaaaacctgccgttttttaccggcaggttttcttatgcaaaaaatcccgcttaaaaaacgggatttgtttaaaatgcctgctgaatgaatttgtttctgataaacggtatttttaaaaagaaatgaatgaatgtccgtctgatccccggctggctgagcacgctgttcatcagacggtagcggttttggtaaacggctaaaacagatacggcgcataatgagtagatcaacaattttttcatcttatccctcctgcccctatcgtttgtcaaacagcgagaattattccggtgcaaaaagttttttatgcgattaagcgatggtttcagattcagtcacgatcatatcgaccggaatatcgtggggcatgcggggaatgcggtctgtcagctggcagtcaaagagaagcgacacggtacggcctttataaccggacaggtaccgatcataatatcctccgccgtatccgattctgaagccttcccggtcaaaagccacgccgggcacaatcacaaggtcaatgtcattttgggcggctttttccgtcagactctcgatcggttcgctgaggcccgcatatacggtttccagctgatcatacgcagaaaatgtacggaactccattgctcccgtctgcggaaagcattttgggatacagacttgttttttctcttgccaggcctgttcaataatcggccgtgtcggaatttccaggcgtgtcgagatggtaacggcgatcacgcgggcctgtctccattcttttaaagaaaacagcgtttcacgcatgctgcggcattttttctcccattcactttctgtcatgtcagaaagctttgcttttatatcggttctgatttgtgctttcacgtttctcaaacctccctgaaagacaaaaaagccagaactttattgaaagctccagctttttccgctgtgttaaacagcttattttgtttcacggtgtaacgtagattttttatcacgtgggcaatattttttaaattcaacgcggtccggattgttgcgtttgttctttttagaaatatagttacgctcaccacattcagtgcaagccaaagtaatattaacgcgcattattttccctccaaactaaatatcatttacttattcagacttatatataataccactataatggacggaatgctagagctgatttacatgaaatgttgtttaagtgcagaaaacatcagtttacgcttctgatcctctgaatgagcttgcgtcagaagaaggtaaaatatgacgaaacaggacaaaaaagggctttctgatacgaaatctatagagaaataaccgtttgctccccgagtaaaaaagattttccgacaaaattccgtttttttctctatttcctttagaatggcggcgttttatggtataaaaaagaagggcaaattaataatagaaggtgatgaaacgtggaaattgctattattgcgttgtttatcgtcagtatagcgcttattgcattctcatattctcaaagagatccgatgaaagacgtggaacaggagctagaaacgcttcagctttccgccatgcaggaaatttacaagttgaaaaagaaaatgacggtgcttgaagaagaattgctggaaaccaacctcgtgatccgcaaagccaaaagcagcggcataaaccaaaaaatcgccaaacaaatcatttcaaaatataacaacggaatgtctgcggaagccatcgcaaaagcggagcacgtgtctgtcgaggacgtcaataccattattaaagataatgagaaggtgctcgtatgacaaaacggggcattcaggcttttgcagcaggcatgattttagcgacggccgttctcgccgctgtcttctatttgactgaccatgaccaggcagccgccgttaaaaccgaaaaaacagcattgacagaaaaagaagtaaacagctacctcgacgatcagcataaagtctccgtcaaccgggatgactatcaaaaactgcttgattctaaagaaaaatcgttaaacaacgaccaaaacacagacgccaaaaagaaaaaagtaacatacaaactgacgattaaagacggaatgagcactgctgatgtgtcatccattcttgaaaaagaagggattattccttcagcgaaagacttcaatgattacgtcattgacgcaggctaccacaaagaaatccgcgccggccatttcaaagtcgattcagatatgagctttaaaaaaatcgtcaaaacattaacccgctaaaaaagcttgcaggcatcgtccattcagatggatacggccggcaggcttttttaatagacatataaaacggacccggttaatggccgggcccgtttttttcatccgaattttccggtgatataatcatgtgttttttgatgatccggctgagaaaatattttgcccgtatcgccccactccaccagttcgcccatatagaaaaacgcggtttgatcagagaccctcgcagcctgctgcatgttatgagtcacaatgacgattgtatacttttctttcaatgtcaaaatcagctcttctattttccgcgtggacacgggatcaagagcggacgtcggttcatccatcagaaggacgtccggtttggtggcgagcgctcttgcgatgcacagccgctgctgctgaccgcctgacagtgaaagcgcctgttggtgaaggcgatccttcacttcatcccagagcgcagctgcttttaaagattcctcggcgatttcaagcagtttctttttatttttttcgccgtgaattctcggaccgtacacgacattctcaaatattgactggggaaacggattgcctttttgaaacaccataccgatctgttttcttaattctgccgcatccgtcttttccttcagcagattgcgcccgttatagatcatgtcgcctgtcactttgacattcggggccatttgcagcattaagtttaatgttttaataaaagtggatttcccgcagccggacggaccgatgatcgcagttaccttccgctcctcaaaaccgatcgtaatgtcttttaaagcctgatgggctccgtaccatacgttcatgccgtgaatatcaaataaattctgtgtgtgcaccgcttccttcacaagactcacagtccttccccctatccgaactttccgttaatgtagtcatctgtcttttgcgctttaggactcgtgaaaatttgttctgtctgcccgtattccaccacttccccgtttaaaaagaaagccgttcggtcagacaccctcagcgcctgctgcatgttatgcgtaacgataataatcgaataatcttttttcagttctgtcaaaagcgtctcgattctggcgtttgaaatagggtccagagctgaagccggttcatctaaaagaagcacggcaggtttcatcgccagcgtacgggcgatacaaaggcgctgctgctggccgcctgataacgacagagccgatgaatgaagccggtctttgacttcatcccaaagcgccgccttcgttaagctttcctcgaccgcctcatccaaaacggctttcctgcgttcccccgcatacttcagcgcatgtgtgatgttattgtaaatggatttcgggaacggattcggtttttgaaacaccataccgatttcccgtctgagagacacgacattaatcgcttcacccaaaatattcagcccttcataaaggatctctccctcgcttcttgccgaagcaatggcatcgttcattctgttaatctgtctcaaaaatgttgatttcccgcagcctgacggaccgatcagagccgtcaccgcatgtttttcaatattcatgtttacatcttttaccgcttgtttgtcaccgtaataaattgataaatgcttcacttccaaaatcgaagactccggcaaacgctttgtctgttccgcttgttccctgatgatgtgatcgatcatgttttcgcctctttccgattaatttgccgtaagctttttataaatgacagacccgagccatctcgcagaaaggttaaacaagagaaccgaaatcaccagcaccgccgagccgccgtttgcaatcgcttcggcgtcagggatgattccctgcgtattgacactccatatatgaaccgccagcgtctcagccggcctgaaaatgttgaaaggagatgattcagaaaatgggttcaaatccgtaaagttcagccgcggcgttgtcagccccgctgtaaataacaatgcggccgcttctccgaatactcttcctgatgccagaatggctccggttaaaattgaaggaatcgcactcggaatcagcaccgttttgacggtatgccatctcgatacgcctaaagcgagagaagcttctttcagctccttagggactgcagtgagcgcgccttctgtcacccggaccataacgggaaggttaaagaccgttaatgcgagcgcgcccccgataatcgtgtagccccatccggtcaggtttacaaacatcagcatgccgaacatcccgatgacaatggacggaagcgaagacagcacctcaatacacgttctgataaaatcggtgattttattttggggcgcatattcagccataaagacgccgcccccacaccaagcggtatcgtgatcagcatggtgataaacagaatgtaaaaggagttaaaaagctgatcccgtattccgccgcctgaggcaatggcgctcgattttgacgtaagaaaacgcaaggagatttcagagacgccgtgaataagaatgtacaaaaacaatcctgccaaaatcgccgcgattacagcggcgcataacccgaatacaccggtggccaatttatccgttattttccggttcattacactttcctcctagatgacaagtagcgtatgagcaatataaacagaaacgacatgatgagaagaacaagccccatagaccataacgtattattttcaatactgccgtatgtggtatggcccatgtttaacgtgataatcgtcgttaatgttcccgccgtatcaagcaggctttccggcagaagctttgtatttccgataaccatctgtacggcgagtgcttctccgaacgctcttgccatcccgagcacgacagcggtcagcaatgtcggaaacgccgccgggataagcacctttctgattgtctgccacctcgtcgccccaagcgcatatgaaccgtcgcgaaggtgtttcggaagtgacgcaagcgcatcagcggaaatcgatgtaacagtcggcagaatcattaccgagagtacgatcgtccccgccagaaggctgtgacccgttccgcttgatttaaaagagccgataaacggaaccaatactgtaagacctatgaatccataaacgacggacggaatgccgacaagcagctcaattaccggctgcagcaccttttttccccaagtcggcgcaatttccgtcataaacacggcacccgcaataccgaggggcgctgcgatcagagcggacagaatcgtgaccgcaaatgatccgaaaataaaaggcagcgcgccgaactcaggttttgcctgggttggattccaattcagacttgttaagaactcaatcgggcttacaccatttacaaaaaaagattgcagcccctttatgccgagaaaaattgtgatcgccgctgatgccgcaatgataatcgcggcacacacagacacaatcacccttccgcggacttcatccaattgcctgttttgttttgagcttattaagcgttcgcttacagactctttttctctgtgatttatcatttgtttacactcctataaagaagaagaggcggggagcccgccctcccctcagctttgcttgccgtttgcgtcacgtgtgactttcatatcagagatcggaatgtagccctgatcttttacgatacttttctgtacttcatcgctgttcatatagtcaagaaacgtttttgtaaggcctgacgcttcacctttcgtataagagtgctcgtaagcccaaatcggatactcgcctgtgacgacgtttttctcttccggtttgatgcctccgatcgataaaggcgttactttgtcatcgtttatataagagaatgccagataaccgattgctcccggcgtttccgcaatgatttttttgactgtattggaggaatcctctgtaatgccctctgcaggctctgctccgtcaagagcatatttgacgaacgtagcgcgtgttccagatgaatcaggacggttcacgagtgtaattttttgatctttaccgccaagctctttccagtttttaattttacctgtaaagacgtctgtcagctgttttttggttatatcctttacgcccgcaccggggttgaccgcagccgccatcgccactaccgctactcggtggtcttttagggctttcgcatcaatgccttctttttcttcagcgaagacatctgagttgccgatttgcactgcccttcagacacttgcgaaagtcctgttcctgaacctcccgcttgcacctgcacatcagcatccggatgtttttccataaacttttccgccgctgccagtactaacggctgcatggctgatgaaccagaaatggttaaagaacctgatgcttttttatcctcacttgcagattgactgtctgtcttgccgctttcctttgcatttccgcatgctgcagcaacaatcataacagcagccatcagaagcataagcatccatttgttttttttcatttcctgaattccccctgcatttaatgtgtaatttgtcctacacgtatagagtaaagggttcttgtaaaatgcgtataaatcaagtgttaaggttttgtaaatccggatgtttttttgtataaaaaaaacgctcacaggttgtgagcgtttttctgttagttgcttgtattgccgttttcagcgtcttcctgaattttatcttcgtttttctgcttcgtattattatcttcttgtttctttttcagctcaaagtatttgtccagagctgctcttcctatatcattcgtaatcgaatatcgatcgctgtaattaatataggcccaaggaacgactacagaaatagccacttccggattatcagcaggtgcatacgcgacaagagtcgtattatacgttccttcacccgtctctgatttgtcaggaccgtcatagaaagattgcgccgtacccgttttaccggcaggactgtatgtcgccgtcgcaaaatcagttgcggctgtcccttttgtcatgacacgtctgaaacctgcctgcacttctttaatgtctgcatgattcatatcaatcttgttcagtacttggggctgaacagactctacaacggctccgattccttttttcgaatcaggctgtctgacctcttttacaagctgaggtttcaaacgatagcctccattggcgatcgttgatacatactgcgccatttgcagcggtgtaaacgtatcatactgcccgatggcaaagtctaacagaagaccggaaattcgctgtgtcccttggtacccggttgcttcattcggaagatcaatcccagtcttaactccgagtccgaactgattgaagtagtatctgaaagtatcgaatgccttcatatcaagcggaagggactggccttttttgtactcccctttaccgacagcaatcgccgttttgaacatgaacacgtttgaggattcctgaagcgctttttggatatctacgggacctaaattggtccatgattttttcgggtttttacttcccttgaaatacataggttcatcctggaaaacggtgttcaaattaatcgcgcccgtctgcagtccggtcaacaccgtcgctcctttgaccgccgatcccattgcgtaggaggaagtcattgcgccgagggcataatcattaattttgtactttccatgatcattcgtaatctgtttgccggccatcgtcagcacttctccgtttttcgggttcatcatgacgacgaaggcccgatcaagaagcttcgtgctcggtctcgcttttgccgatcttaaatttttctcaatgattttttcaacggatttctgcaggtccatatcaatggataatacaaggtctttgccggcctgtccttttgaaatcactttgctgcccgtgacatttccggatgagtcggttaagttctgcactttctctttttgaccctgcagcaggctttcatattgatattctaaatagctttttccgaccctgtcattccggctgtagccgagtgacagatagtgatccagcagattggaaggaagaccttcgttcgcactggatacactgccgagcaatgtccggatcaggcttttataaggataagaccgttcccagtcagacgtcacgtcaactcccggcagttcatctaaatgttcgctgacgacggccatttcttttgccgacaccccttcatttttgatgtattgaggcgtcagtgagtagcctgaatccatctgccttttgatcgcaaggatctgcatatcttttgaagtgagctcattcagctgtttgtctgtgatacgtttcagctgaagctgatataaatcatcttcagacagttttttgtcttcagctttttgcttttcttcggccgtaatcagttttttcgcttcatcaggcctcgttaacatccaatagtcttttttatcccgctcagtcacctttttggtgcttaccttaatcatacccgacagtttttttgcgatttttaaacgctgcgcctgggtggttgaggctgaacgtgtatatgtaatcgcatttaatgctttattcgttacgatgggatttaggttccggtcgtatattttccctctcggaaccgccgtgctgacatcagactcctcctgcttattagcggcgtttttataatcatcaccctgaacgatctgcttgatgccaagctcgacgataatccaagtgaaaataagaaacgcggccaaaaacaaaaaattaagccggatcggcagtgattttttcttttctttgtttacagctattttctttttatttctcctcatgacatcaccttttcttatttacagaaagaaatgacaccttctgttcaggtgtcatttttcattctaaaggttttttcgatatttttctacagataacccttttatctttctccttttataaaattcggttccgccgcctgtttttgtcggtcttcttctactgtttcatcagaagtttccgtatccagtctgatgtcttttataaagtaataaatcagcggatggccggctccgagcagcacgagcgccgccggtattcccactttttccttgaataatgtaacgattacaaggaaacaaaggatggaaacgatcctgcccgcatttaaaaataactccctgagcacaatgtattcaattctggcttttctggcaagccgcgcccggcctatcacatcatatgtaagcgagacatacggcacgagcagaactggatagccgatcgcaataaacactccgtacaaaaggagcgtcgtgaagctcattttaaaaatgataagaaacagggcaccgtacaagatcaatccgccgataagaatcgcctttttccgagctctttttttgatgagccttgatgcaaaataataggcaaaaaaagaaaccgcggaattgacgagaccgaatgttccgagcgccagctcactgtttgtcgcaatgaatacaaaaacgctgattaaaaaaacaaaaatcccttctctcaagccttgaaaaaagtgcgcgttggtaatccggcgccaattcagattcgtgtggcgctcatcaaaaacttttttcagcataaaccggcctttcgactccctccgcttcagaaaaaagctcatgaccacggcaagggcaaataagccgagcgacaggctgaaaatgattgtataacccgtattgttttcaagtcttgaaatgacatatccggccacaatcggaccgatcatgcccgccgatgaagacaaaatgcctaaaaacccgttaaaaaaatctctcgtttccggttccgtaatttcgaacgtcagcacattaaaagccagccagtaaaagccgtatccaactccgagcacggcccctatcaaaacgagacgggaagccgcagtttctccagcaagcagcacacttaaataaaaagcggccaaaaagataacgccgaacctgagaataaacaccctgtcaatttttttagccagccggccggccagcagaaaggtaaccggctgcatcgttacgaccgacaaattgtatatggccaaatcaataaattttcccgactgcttccacaaatacacgttgacaaatgtatttgacagcgcgatgcccaatgagtaaaggccgccaatcgtcaataacagcagcagccctttatttatttcgatgtcgccgataattttttttattttgctcatcattgactcccctttactacacattagtttgtctcactcaaactgagatatgtaaaaggattcaaagtcaataaaaaaacaaggcctcccgcgggagaccttgtttgatcgaactatttattttgcttcgctgtaaagacgggcaacttcatcccagttcacaacattccagaaagctgaaatgtaatcaggacggcggttttggtagttcaggtagtacgcatgctcccaaacatcaagaccgaggacaggtgttttaccctctgaaagcggtgaatcttggtttggcgtgcttgtaatttcaagtttgccgttgtttacaacaagccaagcccagcctgaaccgaaacggccggcagctgctgcggcgaatttttctttaaattgatcgaagcttccgaacgtgtttttgatctcttcagcaagctcaccagtcggttcgcctccgccgttcggagataaaagagtccagaataaagagtggttggcatgtccgccgccattgttgcggacagctgtgcggatgtcctccggcactgcgttcaaatcagcaacaagctcatctacagatttctctgcaagcgctgatccttcgatcgctttgttgaggtttgtcacgtatgtgttatggtgcttcgtatgatgaatcgtcatcgtttccttatcgatatgaggttctaaagcatcataagcgtaaggcaattctggaagtttgtaagccataatttttttcctcctttaaatatatgtactgaaatgccgcttaacgcgaacttttctaatctcaatgtaacaaaagaaagcatggtaatcaatgaaaaagctcacaatccggcgattccagcagacatattacactttatccgttccctgccgaaattaaacctttctaaagcaccgtccataagaaatatccgatcataaagagctgaatgacgccttttgccgccacgcttgttaaaaaaccgattaacgagccgagccccacttttgccgcggacttgatatccttttgatgaacaaacacctcagcgcagacagcaccgataaacggccctaatataatgcctgccacgggaataacgaagggcccgatcaataatccgatcgtgcttccccagattgccgccctgcttcctccgtaccttttaacgccaagtaaatttgacacataatcagctgcgaataaaacggccgcaaataccgcctcaatgagccaaaacaggtaagaataaggactgaaggaaaacaaaaatccgtagagaagaaaaccggccacaataaaaataacgcttggaatcaccggatatacaagcccgataaaagcaatgatgaagaccgcaatgataatcagccaatacaaaacactcatgacaaaaacaccctcctttgttttgcgggcgatcaccgcttcccgctttatcttattatgtatgattccttatcaccgctttaaatactctcacttgtgttcatcccctgtgaacgatacaataagcaacatataccagtttaggctaggaagtgaagatgttgaacatatttacggctttattgaaaagtacatactctccggcagatattgcaaaaacacggtttcaggggataggaaaagcgatcctttatgtatttttgctgtctgtcctttttacgctgccaagcgcttattacctttgctccggcaccgtaaactcaatgaacggtttcaaaaccgtgttaaagaaagatttccctgatttcagcatttcaaacggagaattgcagacgaaagcgtccgcctctaaggaaacggaagcgaacgggttcgtcatcgtctttgatcccacagatgcttacggcgcgaaacaaatagcggcgaaacaaaatgcgatcggcattttgaaaaataaaatggtgcttgctgtagacggacaagcgacagaaatgaattattcgctgatgcctgccgatatcacaaaaaaagaaatcatatcagcattaaaccaaaataaaacaatgatcgtcaccgtcctgtccgttttgctgttcatcatgacagcggcaggcaaattcattgaagtatcatttctcgccgtcatcggcctgatattgaaaaatgcgcaaagaaagacattgaattaccagcagctctggaagctttcggcttattccattacactttcgaccgtattctttacgatcatgcgcgcgcttgttattacggtgccgagtgaatttttagtgaattggtttgtaaactttatcatccttttcctcgtcttaaaagagataccgcgaagtaaaacagatgtataacaaagactgcccccggcggtcttcttttttgtcatgaacaaaatgggacaagcatacaatgaagtaaaaatgtatgcgggaggcggttggaatgaagcggcttacttttgtattcggcagtttatttgtgatattcattatcttttacgatcttaaaatcggcacgatcccttctcaagaccttccagcatacgcagcggcggcacagccagcccaacaggaagcttcatacagaacggttacggtcaaaaaaggcgatacggtgatgtcgatagtcggcgcacataaagcgccagatgatattgcacaagattttgaagcgctgaatccgaatgtaaaagcaaacgccattcaggcaggcaccgcttataaattccccgtctaccgcaattaaacgttaatttcttgtcagttcggcaaatacactgttacaatataacatgtaaatagaagttgcctgacatgtaaaaggctcagcctgcaaaagcggtaactacaattaaggagcgattgacaagtgagtgaaatcacacatcgtacaaaaacgcgtcccgtcaaagtgggacctttaacaataggcggaaataacgaagtcgtcattcagagtatgacgacgaccaaaacacacgacgtagaagcaacagttgcggaaatcaaccgtttagccgaagccggctgccaaattgtccgggtggcatgtccggacgaacgcgccgctaacgcgattgccgacatcaaaaaacaaatttccatccctctcgttgtcgatattcattttgactacaagcttgcattaaaagcaattgagggcggggccgacaaaatcagaatcaatccgggaaacatcggccgtcgcgaaaaagtggaagccgtcgtaaaagcggcgaaagaaaaaggaattccgatccggatcggcgtaaacgcgggatctttggaaaagcgcattttagaaaaatacggctatccgactgctgacggaatggttgagagtgcgcttcatcatatcaaaatcctggaagaccttgactttcatgacatcatcgtcagtatgaaagcgtctgacgtcaatctcgccatagaagcatacgaaaaagcgtcaaaagcatttgattatccgcttcacctcggaattacagaatcgggcacgctgtttgccggaacggtaaaaagcgcggccggactcggagcgattttaagcaaaggaatcggtaacacgctccggatctctctgagcgccgatcctgttgaagaagtaaaagtagccagagaactgctgaaatcattcggtcttgcttcaaacgcggctacgcttatttcatgcccgacatgcggacggatcgaaattgatctcatcagcatcgcaaatgaagtggaagaatacatttctaaagtcaaagcgccgattaaagtagcggttctcggatgtgccgttaacggaccgggcgaagcaagagaagctgatatcgggattgccggcgcacgcggcgaaggacttcttttccgcaaaggccaaatcgtccgcaaagtccctgaagaaacaatggtcgaagagctcaaaaaagaaatcgacaagctggcagaagaacactatgcaaagcttgaagcagaaaaagcaaaagcagaacaagaaacacaaaaagcttgacggatattccgccaagctttttttttgcgttgtgttaaaaaaacggtgtaatgaagatgccaagcacaagggaaacaataccgattcccatcgcccatccgcctaaagcgcctgctcctcttcttctggcgatatagccgacgataatgccgcatgcccctaataaaacagggagcacaaacagggaaatgatagaaatagccaatgctgcataccctatcccccggccttcacttactccgtcccgattatcatcacggtctgctgcccggtcagaagcacgatatggctctgagatttcggccgctgtttcttctgaataaacatcacgcgtgatatcggttccttccgatccatgatccacgtaatagtcgttgccttttcgattttcgtaatcgtatgccaccttcaattccccctttttcttttatgaaaggagcttttttagtttccgcgttttttacggattcatgtttgctaaacttttctggtattgttaattgtttatgttacacttgaagggatgaatttataggagtgtggacatgttacggttaggtatagatattgacggcacagttacggcacaggatacatttgtcccttatttaaaccgctcatttcatctttccattaccttggatgatatgactgattatgatctgacgaagcttttgaacattacagacgaggaattttgggaatggatgaacgttcatgaagcagccatatataaagaagcgaagctcgcggaatttgccaagcaggcactggacggactgaaagaagagcaccgtcttatctacattacggcaagacgcggccacttagaagatgttacgctggactggtttgcaaaccgggacattcattacgatcacattgagcttgtcggaggccatcacaaagtggaagccgtcaaaaaacacggcattgatttatttttcgaagatcaccacggcaacgcgacaatgatcgcaaaagaagcaggcattccggttatcctttttaactccccatataatcagctccccatcgattccaatattatcagggtgcataattggcttgaagccgtcgcctggattaataaaaacaaacacagctttcagcatgttaaaagctgaaaaaaacctcctgtatatagcaggaggttttttatcggcacgccggacaggtgccgtaaatttcaaacttatggccgctgatttcatacccttccaaatcatcgtgcagcttatccatcggacaggactcaatttccttcgttttcccgcaggttaaacagataaaatggtgatgatgatgggtataagagcatgtaaaacggaacagtttttctccggaaagctccgtcgtttccaaaatgccgagttcttcatataacgaaagatttcggtatatggtatcaaaactcagacccggatagtcgtcatttaatgcggcaagcacgtttttggcggtcagatatttatcagaatcagcaaaaagctgcagcatgtcttctcgcttactcgtatatttataccctttttctttcagcaggttcaacgcttcttgtacgttcatgaggacctcccctttacaacacggtatcgctccaaaaagaaaatggcagctgtctgaacagcaggccattttcttatgatgtatcaaattatacctataaaatgatgaaaagtaaatgaaagcctagtgaatcgcggttttgaacttaccgcccctcgtttcatgggtattcatgatcgtaataaaggcgtttttatcaatttcaaacacaatggatttcaatttagtcacttcaagccttgtcacgaccgcgtaaatgacttctttggattcatccgtatatccgccttttccctgaagcttggtggttccccttccaagccgatgcaagattgcgtctgaaatttccgcatactgatctgccacaataatgaccgcttttgtttcatcaagcccctggatgacggcgtcaatcgttttcatggcaatataataagtcatgaaagaatacatcgcctgctccggaccgaacacaaaaccggcccaaataaaaataaacacattgatgagcataacgaattctccgactgagaagggcagcttttttgtgagaaggataccgagtatttcagtaccgtccatcgagcctccgtttcggatgacaaggcctaccccgaaaccgagcaaaagcccgccgaataccgtcgccaaaataggctgggtcgtaatggcctccacatggtgcaaggaggattcaatcagcgctaaaccgacaattccgataacagtagagatgagaaatgtttttccgatatatttatatccgaaaatcataaatggaatgttgagtaacacaacgaataaggcgaaattgaggaggggattggacataaagaggtggtctaaaattaatgaaacaccgataatgcctccgtcgataaaattattagggaccagaaacaattcaatacttacagcggctgaacccgccccgatcagaatcataatgaccctgaagataaagtgtaaaaatgactctcttttatgctgtttatttggggtcataaaatctcctttcctgtaataactattttaaacagtaagcaacttcattttaccattaaaagccgtaacattttaatgatttgctcaatacattatgtctaaagaggtgaaagtatcgatgattttaatacaaagaattattttgcagcggctcaatcaagtcactgcggacgatcttctgaaatattccaagcaatacggaatcagcattacgagaagtcaagcggctgaggtagcggctctgatgcacggaaaaaacatcaatatttttgatgaacaggagcggcttcgcctgctgaaaaaagtagaaacgataacctcaaaagaaacagctcggaaagttgacgaacttttcaaccaattctcagggtaaaaaaggagggggcaattccccctccttttttattgagctgatattttttcaagaagctcctgatcaaactgcttttctttcagcatttcgatttcaaaacggtacggcggcttcttatttttcttgtcttcgcctacatacggtgtttcgaggattttcggaatatcggcaagctgctcgtgatgaacgatgtactgcagagcgtcaaaaccgatctctccgaacccgatattttcatggcggtctttccgggcgcctttaatatttttactgtcattcacatgaaggacttttatccgatcgatgccgacgattttatcaaactcgttaagaacaccgtcaaaatcattggcgacatcatacccggcgtcatgggtgtggcaagtgtcaaagcagacggatagatgttcattatgcgtaacccccgcaatgatctcggccagctcttcaaagcttcttccgcattctgatcctttgcccgccattgtttccagcgcaatctgcacgttttgaccgggaacaatcacttcgtttaaaccttcaatgatttttttgatgcccgtctcagccccggctccgacatgcgctcccggatgaagcacgatctgtttcgcgccgattgctgccgttctttcaatttcagaacgcagaaaatcaacacccagctcaaacgttgccggatttgtagtatttccgatgttaatgatgtacggcgcatgcacgacaatctcatcgatgccgttttccttcatatgggcgcggcccgcttcgatattcaagtcttcaatttttttgcggcgcgtgttttggggagcgcccgtatagatcataaatgtattcgccccgtacgaaacagcttccttgcttgcggcaaggagcatatgttttccgctcattgagacgtgtgaacctattttcagcaacccgagtcccctactttcctttgttagatttgtttcttctctgctttctttttatcttttccatttcgtagctcattttctttttatagcccggcttcacttttttcggttttttcacgaggcgcttcgccatttggtcggcctcattctccgattttttgcgttttttgcggcggtggcggtcatcgcctttcttccattcgccgtttacaagctccgcatagtcaaacacaatacccatcttttcgagtcttacgagcgcatcttcgtcagaaagctcataaatggtcagtgcttggcctgatgaaccggcgcgtgcggttctcccgacgcggtgaacataaaaatccagatcgtccggaagctcatagttgatgacatggcttacgcctttaatgtcaattcctcttgccgcaaggtctgtcgcaatgacataagtgaattccagatcattaatctgcttcattaccttcttacgctcacgcggcgttaatcccccatgcagaagaccgatcctcatgcccttttcagtcaggtatttcgcaatatggtcagccgtgtttttcgtattggcaaacacaatgcccagataaggattcagatgagacatcatatcaaaaagcagcttgtctttatcacgctgtttagaaggaaccaaaacatgttcaatcttttcggctgtgattcttttcggctcaacatgcgcgtacttcggattttccatatactttttcaaaaacggcttcagcttttccggaatcgtagctgagaacacaagcatctgaagttcttccggcatccgcgatccgatataatcaacatcttctaaaaagcccatgtcaagcatcagatctgcttcgtcaatgacgagagactgcgctttatagacgttcaatgcctgcgccttaatcagatccgcgatccggcccggcgttccgacgacgagatgaggctgtgttttcagcttatcaattgatttttgcttgtccgtccctccgatgaaacattttgtccggatcggctcatcttccgcaccctgtgtgattttgagcgcttcctgatgaatctgattggcaagctctctcgtcggcgccgtgataacagcctgcaccgtatcagaacccggatcaatccgattcaaaattggcaataaataggcgtgggttttccccgtccccgtctgggactgcccgatcacgctttcgtttttcagcacggcgggtatcagccgcttttgaatatctgtcggttcataaaaaccaaggcggtgaactgcatctataataaacggttttaagttgtatccatcaaatttagtttctttcatttttcccagctccttaaagcggcacattctgtgtccatcatcacattataaccgattttacttaaaaacaccatgtcttgggggaatcctgttttcgagacagaaaagcaaatgccccctccgatgcatattgtaatagcagagagacagaaaggaggtacaagtatgtttccacagcagccgatgagaaatatggcgcagcagggccggccgttgatgaatccgcgtatgatgatgggaggaagaccgtcattgccgggccggcagctgatgcagcagggccggcagcttttccctcagcagcagattgccggagcgggcctgagaaacgcaggcacgggcggcggagggggcttaaaagggatgctttcccgttttttacccggttcaggaggaggaagcgctgccgcgtcggcaccggcggcggccagcggaggagcaggtgcaggactgcagggaatacagaacctggcaagtccggcatccctgtcgagcatgctcggcaacgttcagaaggtgctcggcgtggcgcagcaggttacaccgatgattcagcagtacggtcctttagtacggagtctgcccgccatgatgaagctttacagccaattaagcagcagcgatgatgagaatgaatctgacgagacaaaagaaacaaacgaacaggataaaaaggatgaagctgaaaaaacagatgaaacagaagatgaaaacaaatcagacgcctcatccaacacatcaaagaagacgtctgaaaaagcatccgcttcaaaagaaaaagacgccgcacaggcagactcagcggaacagccgcgtccaaaaagaacatcgggcagatcaaagccgaaattatatatttaacattctttgatatctcacgaaagattagctataatgagatcagaagaatgcaagatttgagccgtttaactacggctttttatattgcctctacactcacttttgataggaggacatctacattggacgttatcaaaatatcgccgcgcggctactgttacggcgttgttgatgccatggtcatagccaaaaacgcgtcactcgataaaacactgccaagacctatatatatactcggaatgattgttcataataagcatgtcacagatgcgtttgaggaagacggcatttacacgcttgacggcacaaaccgtctggagattttaaagcaggtggaaaaaggaaccgttattttcacggctcacggggtatctccggaagtaagaaaagccgctgaggaaaaagggcttgttacgattgatgccacatgcccggacgtcacgaaaacacatgacttaatccgaaaagtaaaagctgaaggctatcatgtcatatacatcggcaaaaaaggccaccccgagcctgaaggagccgtcggcgtcgctcctgaaatcgttcatctcgttgaaacagaagaagacgtcagaaatctcgatattcaggctgagaaattaatcgttacaaaccaaacgacaatgtcccagtgggacgtccacgatattatggaatcagtcaaagaaaagtacccgcacgtggaataccatcaggaaatctgcctggccacacaggttcgtcaagaagctgtatcagagcaggcaaaaaaagcggacttaaccattgttgtcggcgatccgaaaagcaataactccaacaggctggctcaagtgtcagaagaaatcgccggaacaaaagcctaccgaatcggagacatcagtgaactgaagctcgaatggctgaaagacgtcaataccgtcgccgttaccgcaggcgcatcaacaccgacaccgattacaaaggaagtcatccgctttttagagcagtttgaccacaacgatgaatcgacatggcagcttgaacacagtgtgccgctcaaaaaaattcttccgaaagtaaaaataaaaaactgaggcccggggcctcagtttttttataagaaggtaaatgggtttgtatctgtttcggaagcgaaaatgcgcacgtcatagtttttctctccggccattgccgtaagcttctcagccgtgccttttctcatgatcttttcagcataatgccccgggtccacgacgtttaatcccatcatcatcgcatcatgcgctacatgaaaataaaggtcgcccgtcacgtaaacatctgcacctttccgctttgcctgataaatatatttatttccgtcgccgccaagaaccgcgacctttttcaccttgctgtttcgctctccgaccatccggactccgttaacgtcaaacttttctttcacaaacagagcaaactcttcaagcgtcatgtcctgctgaagttttccgatccggccgaggcctttttcaagcggagactgctccaccggataaatatcatatgccacctcttcatacggatggctttttttcagcgcttttacgacggttttctccatacttgccggaaaaacggtctcaagtctcacttcatggacgagttccagctctcccgtctgtccgataaacgggtctgccccgtccagcggcttaaagctcccgattccctcagaagagaacgcgcaatggctgtaattgccgatatgtcccgctccggcgttgccgagtgcggttcttacagcttcttcatagtctttcggaacatatacggcaagttttttcatcgggtccgaatatgtcgggacgagcacttcagtgtctgtcaggccgagagcttcggcaagcagatcgttaacaccgccgtccgctacatcaagattcgtatgagccgcatatacggcaatatcatgctttatacatttctcaatcagtcttccgcccggctgatcagtggtgatctgtttaagcggccgaaaaatcggcggatggtgggcgataattaagtcaacttttttctcaatggcttcatctaccgtttgttccaaaacatccagtgtcaccatgacatttttcaccggcttattcaatgtaccgatctgcagtccgattttatctccttccaccgcataagccttcggtgaaaattgttcaaacagctggatgatttcctgtccgttcacatgtttaggcatgtccgattacctccttcagcagagaaatccgctctttcaattcagctaatttttcatgattttcatgctttgcgctgcggctgatctgttcataaatttgttcagtatgcttaagttcctggctccatttccgaagaaacacttcattcctctcttttaacaaaaacggacccgcaagcattccgacagccatcggcacatcccgataaggcgcatcacggtcgccagtttccgcaacgaggatttcataacactttccgtcttcttcgagaatcacttcatcaagcagttcatagccttcctgatacagccactctcttatatgaacggcatgaatattcggctgcagaatcagccgttcacgccctgtcaatttcgtttttcccgactccaaaatatgagcgatcagcgctccgcccatgccagcgatcgtaatggcgccggcttctcctttttcaaggacgctcagcccgtcacctttccttacggagataagagtgcttaagtgcagtttttccacctgctgtttggcggatagaaacggtccgtctgtaatttcaccggcgattgcccggcttgccaaatgattcaaaacggcatagcaaggaagatacgcgtggtctgacccgatatcagcaaccagggcacccggagggatatattccgccacagactgcaatcttttcgataacttcatttcattcacaatatcacaacttttctcaggttctttttcctttactatcatataaaaaaaccgcccggaatccaagcggcggatagagtttttcatatgtcttttatatagggaccggtaaagctttatttaatgtcagaaacccattttgccatgtcatccagcttttcggccggcacaaggcccgcgggcatcccgttgccgcctttttcaatttttgttttaatctcagcgacatcttttcttttgccgacgccttttaagttcggccctgacacaccttcatagttttctccgtgacaggtgatgcagttggctttataaatctcttcaggtgaagcgtttgcagtttccttctcggcatttttgctttcaccgccgcttgcgatctgatgcgcatctccattgccttttacagctaaaaagaaagtcagccctattcccagcactgcaatgagcaaaaaaggaatcagcggattccacttcatatctccatccccctttttcattctccccctatgtaaacacttctaattctaacttatttttacaaaaagtaaatggtcttgctcagcaatttcaatgatttcacaatttatacaaaaagcaaaaataactgttttgcttaccacaaaattatctttattctattgtataatgaattgtatacgcttacaataaagaatataaataaacttgtctcatttcccccctttcaggacatgccgcattttttccaaactcatttgcaaaacatatgcttatccagtaaaataaaggtatattatccatatatcttatacataaaaaagaacggatcaaaaagacccgttccattctattcgagaaaatccttcagacgcttgcttctgctcggatgtctcaatttgcgaagcgcttttgcttcaatttggcgaatacgctctctcgttactccaaacactttgccgacttcttccaaagttcttgtgcgtccgtcatccagaccgaaacggagacgcagcacgttttcttcacgatctgtcaacgtatccagcacatcttccagctgttcttttaaaagctcatatgccgcatgatccgacggagatgtcgcttcctggtcttcgataaaatcaccgagatgtgagtcgtcttcttcaccgatcggtgtttctaaagaaactggctcttgagcaatttttaatatttcacggactttttcaggcgtaagatccatgtcttcagcaatctcttccggtgtcggctctctgccaagatcctgaagaagctgacgctgcacccggattaatttattaatggtttccaccatgtgaaccgggatacggattgttctcgcctggtcagcgatggcgcgtgtaatcgcctgtctgatccaccaagtcgcatacgtactgaatttatatcctttacggtagtcaaacttctcgacggctttcatgagacccatgtttccttcttggatcaagtctaagaaaagcatgccgcggccgacataccgtttagcaatgctgacaactaaacgaaggtttgcttcagccagtctgcgtttagattcctcgtcaccctcttcaattttttgagcgtaggtgatttcttctttagcagaaagaagatttacccgtccgatttccttaaggtacatgcggactggatcattgatctttacgccaggcggtacgctgaggtcattaaggtcaaattcttcttcggctttggcaagctgttgaatattaggatcttccgtttcttcattttcactaattaattcaacaccttgttctcctaaaaattcataatactcatccatttggtctgattcaatttcaaagctggacatgcgttcagcaatttcttcatatgttaaaacgccacgtttttttccagtttcagtaagctgctcttttacctggtctaatgtaagttctgtttctgtttcgtgggtttgtttatcagccattatggatccctccttccaaagcttgcaacgaattctaaaagcggtatgtttcttatccgacccggaagccttctctctttttcagcatgcagggctgcggataataatgacaattcatgatgaggttaagcgatctatttgctcctccgcaaggaatcattgccaatcagaacgcaagcctctatttgttgttactttaatgatcggttcaatgcaacaatttcttgagccagagacgcagctttcacgaagtctttctgcctctccgcatccgctctttctgcttctttttcctttatcattgaccattttcggtgatccaacactttttttacgtaatcggataactcggcctctgagagctcctcgtttacttggagcatccctatatctgaaagcagctggctgatttcctcatcctgcattctcgccataagatgctgcggcgtcatgtcagcaccctcttcataaacagcgtacaggtatgctgccagcgcacgatgtccgtcaatgttaaattcaaagccgacacgctcaatcactttcttgatgacgtttcggtctctcagcatatgagcgagcagaagtctttccgcgttctcataggcgggacggagacggcgccgtttcgctttagtcgtcacccgggcccgtcttgtctgcggttcggcgtttttgtcgccgggggcgttttgtctggcgtagatggaaagctgttccgtcaaagattctaccgaaagagaaaattctgaggcgagctgcttcacatacatttcctgctcaagcgacccggaaagagcgctgatttctttcagcacttctttcatataagcgagccggtctccttcgtcagataagtttttccctttgcggaaatattgcattttaaaagccatgaccgtaacgcttgcatcaatgatatcggtccggaatttttctccgccccgggttctgatataatcatcaggatcaagcccgtcaggcagcatgcttactcttaccttacaatcggctttctggagcaggccggccgctttcagcgtagcttcgtacccggctttatccgaatcgtagcagagaatgacctcctgaacatttcttctgaggattttcacatgctcttcggtgagcgacgtccccattgtggcgatactttcttttacgcctgagctgacggcggatatgacgtcagcgaagccttcaaacagaacggctctctcctctttcctgatcggcaggcgcgccttatgaaagttatacagcagcttagatttatgaaacagcggcgtttccgggctgttcatatacttcggctgctggcttccgagcgcccttcctgaaaaagccgccacggctccgtggtgatcatgaatgggaaacataattctgtttctgaaacggtcaaaatacccgctgccgtcttctcttctgatcagcagacccgctttttccatcatttcttcctcaaaaccgcgctttttcaagaatttcgtcatgaaatcccaggaatccagcgcgtagccgatttcaaactcatctatgagctctttcgtaaaaccccttgataaaaggtaatctaacgcttcctggccttcctttgtatttattagcaaatgatggtaaaatttcttcagaagctcgtgggcttcctccatcttctgctctccggaagattcaggcctggatgcagagtgaatcgttatatcatcagggaaatcaatctgatatttatccgcaaggtgagaaacagcttccgtaaatgaatagccttccatctgccgtaagaaagagaaaacgttcccgcccgctccgcatccgaagcaatgaaagatctgcttatcgctggagacggaaaacgagggcgtgttttccccgtgaaacggacagagcccaaagtagttgcggccttgctttttcaattggacataatcacctatgacttcaacaatgtctgctgactgctgcacctgattaactacttcatctggtatgcggtttcccatcttataacactccgtcgtacattattcgatgttttgatttgaaatcccttcatcattcgacaggatttttttaagcagggtaacaaatcgattccgatcttctttatttaattttttaggtcctttggaatgaatgccgcttcttctcattttgcctgacatatgacggctcatcagagcgaagtcaatcgtgtcttcagtataagaacggcccctttccgataagacggcaatatttctgttcagcaaaagagatgctaaaccgatatcctgcgtgactacgacgtctcccgatctcacatggtttgcgatatataaatctgccgcttctttatgaggatcaacgtatacccagttctcgtctttgcttctggaaagctggtagtgttcaaatgatgcgacgaaaataacccgaacgctgaattgcgatgcaatgagcattatttcctcttttacggggcatgcgtctgcatcgacaaaaatcgtcttttctttttcatttagaagactaattctccatccctccatcaatctcctgcataaaaacaagcgaaatcgcatatgctccatgactgcggatctattttgagctttgtcgaaaaatttccgggagttattcttgacatcttacccataatagtttattcgtatcacacgaagcttaaacctaaaaataaacattttatcacaattttttattataatacaaacttcgcgaagatgccatcctttttgtttattccctatttgcatacccaaaaacccaggataaagcgtcctgagttatcggccctttgttttgagatgatgaatgatgttcgctgtttcttcgactgctttattcgaaacgtcaacgacttggcagccgatccggtccacgattttctcaaaatactccagctcttctttaattctgttgatattggcgtaaatggctttgtcatttaagccgagagattttaaccgttctttacgtatatggttcagtttatcagggctgatttttaagccgatgcattttttcggatcaacgctgaacagttcttccggcgggtcgacctcaggaacgatcggcacattggccactttcagacgcttatgggcaagatattgtgataatggggttttagacgttctggatactccgagcaggatgatatcggcttttaaaatgcctcttggatccctgccatcgtcatatttgacggcaaactcgatcgcctcgacctttttgaaataatcttcatcaagctgccggacgcggcccggttcatatttggcggtcaaaccgtaagccgattccattttatcgatgagcggaccgataatatcgtaatacagcacattcgctttttccgcttgttcaaccaggtatttgcgcatttcaggaacaacgagcgtaaaacaaataatgccgccgtccgctttggcgagagacacgacttcattaatggtgccgatatcttccacataaggtattcttctgatatgcgtatcatcggctgagccgttaaactggctgagcgaggcttttacaacgagttcggcggtttctccgactgagtctgatactacataaatgatgcgattgtccatgttatccccccgttagttttcaagcttatatgatttcattttctgataaactgacaagtatcttagtcatattcgttttggtaaaccggccgatgacctcaaagcctttatccgtatctttaataacgggcagggcatcgatctgtttttcaattaaatacttggcgatgtccatcacataatcatcacgccggcagacggcgatattcggcattcttgtcatgataatatgaaccggtattgaggcaagttcctgctggccgatgctcgcccgcagcaaatctttgcgtgacagcacaccgactaagacagcatcacgatctacgacaaataacgtgccgacatcttctaaaaacatggtgcagatggcatcgtataccgagacattttcattgatgacaacagggatcgattgaaaatctttcacttgcagctttttcaatttatccgcaagcagctgatttcccgttttccccgtataaaaataaccgacccgcggacgggcctctaagaagcctgacatggtgagtatggccaagtccggccgcagcgtggccctcgttaaattgagctgttctgcgatatgctctccggtaatcgggccgttttcctttacaatctgtaaaatttgttcttgccgtttatttaattcgatcgtactcaccacctttatggaagggtttctttatctatgttttcattctgtgatgtttatgtaaaaggggaaaagacgattgccgatcacacagcaaccgtctttttctttattttacaataagatgattcatattagcaaaagacttgatcacatctgcaagagcggtcatttgcgctaaacggttggtttttaatgcttcatcgtccgcatttaccatcgtgtgattaaagtaatcttcgatcggctcttttaatccgctgagcacggcaagcgcctgttcatagtttttggaggcaaagctttccgcgacactgtcttttgttttttcataagcgtcaaacagctttttctcctgttcattttcaaacagatccggcttgatatcgcggctctcgccttttttactgatggagataacccggccgagtgattcagccgtttctttaaagccgggtgtgccgaggtgcttctcaagcactcttgccttatgaacggctgcatacggctcaagctctgtgctgtccagaacggcatcaataacgtcatgacggatgtcttcagcgtttaatacgtatttcagacgctgtgtaaagaaatcaaggagctcattctctttttccgtttctgtcaacgacagcagttctttaaaagaaatgccccagttgcggtcgatcagaatggaaacaatgccgcttgcctgacggcgcaatccgtacggatcctgagaacctgtcggaattacgtcaatgctgaagaaggaagcaatcgtgtccagtttatcagctaacgccacgaccgcgccgataaaggttgaaggcacttctcccccggccgctctcggcatatagtgctcattgacagcggcagcgacggcatcatcttcaccgagcatgcgcgcatatttttctcccatcacgccttgaagctcagggaactcatagatcatatgtgtaaccaggtcaaatttagaaatctctgcggcgcgcttcacaagtttttgcgtctgttcatccgctttcaggcggacggcaagtttgcccgcaatggtgaccgctcttcttactttatctccaagggagccgagctcttcatggaaaacgatattttccaatttcttcacgttttcatcaatgttcagcttttggtcttctttgtagaagaacgcagcatctgaaagccttgctctcagcactttctcgtttccgcgggcaacattttcaattgcatggctgttcccgtttcgcaccgtaataaaatgaggaagcaaattcccgttttcatcttttaccgggaagtagcgctgatgctctttcattgttgtcacaagcacttcttcagggatagaaagaaactcggattcaaaagatccgtaaagcgccgtcggatattccaccagatggttgacttcgttcagcagatcctcatcgaccggaatgttccatttcttcttggccgcaagcgcatccagctggctttggatcatttgtttgcgttctttcgggtcagcaatgacgctttgttctttcagcagcttttcgtatgatgacggcgcatcaacagatacttcttggccgagaaagcggtgtccctgcgtgttccggcccgtcttgacatttgtgatttcaaacggaatgacgtcttttccaaagagggcggcaatccatttgatcggacggatatagcgcagatcctgcgtgccccagcgcatgtttttcggaaaatgcattccggcaatcaaattttccagttgcggtaaaagtgtcttcgtctcttgtcccgcctggaatttttgaacgaagacatattccgtgccgtttacatcttttatatacaggtcatccactccggcgccttggccttttgaaaatccgatagcggcttttgtccagtttccgtcagcatccagagcgatttttttcgcagggccttttgcttcttcctgaatatcagcctgtttttctgctacgtcttttatatatactgccagacgtctcggcgtattaaaaagtttcacttcgccgtgggcgatatttttttcagcaagccagccggtcagcttttcaccgagctgcaccatgctgtcatgtaaaaaccgcgccggcatttcctcgagtccgatctctaaaagcaagtcttgtttactcatgggaagagccctcctctttaagcattgggaaccctaatttttcccgttcttcataatacgtttttgccacttttctcgctaagttgcggacacggccgatataacccgtccgctctgtcaccgagatcgcgccttttgcatcaagcagattaaatgtgtgagagcatttcagcacataatcataggccggatgcacaagcccgttatccatttgtctgatcgcttctttttcataggtgctgaacaaatggaaaagcatatccacgtcagatgtttcaaaagtataaacggaatgctcatattcagccatcataaataaatctttcacagtaaatcctgacgtccattcaagatcaaagacgttttctttatcctgaatatatgacgcgagacgttcaataccatatgtgatctcaacggacaccggcttacattcaattccgcccacctgctggaaatatgtaaactgagtaatttccatcccgtcaagccatacttcccagccgagacctgcacagcctaaagacgggttttcccagttgtcttctacgaaacggatatcatgttcaagcgggtcaatgccgagcgcacgcaatgaatcaaggtaaagctcttgaatgttatcaggcgacggcttaataatgacttggaattggtgatgctgatagagcctgttcgggttttcaccgtaccgtccgtccgcaggccgtctggacggctcaacgtaagccactctccacggctccggcccgatgcttcgtaaaaatgtatacgggctcattgtgcctgcgcctttctccacatcatacgactgcatgagcacacagccttcattcgaccagtgcttctgcaaggttaaaatcatatcttgaatgttcatttcaagcacctccactttctccattcttttacaagtgcggcggcaaccaaaaaactcccgtctctatgcttgccggccgcaaacatagggacgagagttctcccgcggttccaccctagttgctgaggatgtgaatcactcagcctctttttaaagggttgctcgagaatgcctttcgttgcgcgctcatccttagcttacactgtcctaaggtcgcttgtatgagttggacgcaagtacttctttctgtcactgcaacatattttataataaatgatcatataaaaagatgggcagaatgtcaacttttgttttcatccaaaaggttcttcatgctttccatctggtctaaaaaccgttttgactttaaataaagtcctgaatattcctcgtaatacagatcaatgacctgtttaatttcgtttttggtttcctgttttaacgagacgctgccgagccttccgatatcaaagtaataaaaaagccttagcagccttgccgtttgcggcgaaatcggaactctgtacggatccttttcaaagcagcggtggcagataaaaccgttatctcttatcgaaaaatgaaacgtcccttccccgcttttgcagtggacacaatgattcagctccggatacagccccatgacgccgagcattttcatctgcacgatgaatgtgatcacgtccgggtcagtcccgtcattcagcctcttaaaggattcgagaatcaattcgaataaataggggttcggtttcttctcttccgttcctttgtcagtgagttcagcgataaaagcggcatacgccgtcaaaaataaatcttctctgatcgttctcatgctgagaatcatttcaccctgctggagcgtgccgagtccggatgttctttgcattaaaaatgacccgtacaaaaacggctggctgactgctgacagccggctggctgacttcctggcgccccttgccatgacgccgattttgccgtgttccctcgtcagcaatgtcacgattttattcgtctccccgtagtcattcgtacggagcacgattccttcacatttagtcagcatttccgcaccttccaacaacgggaggggccaagaggtttacaaaattggaaaatcaattcgggctagctcatcttccggttcttcgggtctttccaggttctctttttccagttctttaaaaagaaggtacgtatcaacacttcctgtttgagaaaatacgttccaggtaaaattcaacacaaaaaacccacctttcatcattaaactagcttgccaatccaaattcttacccttatcttgacctgatgtcctccttttcatgttaaacaaattttgctaacgaagccctgtttctgtgaggtaatcccacacatcaggcatgcgctttagatgaattaatattcatcctctttgaagccgaaatcacgcagctgagacattttattccgccagtccttctgcactttcacccataattcgaggtaaacgcgtgaacccagcagcgcttcaatatcagcccgcgctcttttgccgacttctttcagaagcgctccttttttcccgatgacgatgcctttttgagaatcccgctcaactacaatggtggcggcgacatggacggagccgttttcctgccctttaatggactcgatagcgacagcgatgctgtgcggcacttcttcccttgtcagatggagcaccttttccctgatcagttcagaaataatgaaccgctcgggatggtcagtcacctgatcgctcggatagaattgaggcccttccggtaaatacgcttcaacctgcgcgagaagggtttcgacgttgttcccttccaaagctgagatcggcacgatttctttaaacggatagcgcgcacggtactcatcaattaaaagaagcagctggtcagggtggatcttatcaattttgtttacgatcagaaagaccggcgtggacgtctgtccgagcttttcaatgataaactcgtcgccctttccgtacccttcttcggcgttgatcataaataacaccaagtcaacttctttcagcgtattctgcgccactttcatcataaagtcgccaagcttgtgcttcggtttgtgaatgcccggtgtatcaataaaaatagtctgcgacgtgccggttgtcagcaccccttggactttatttcttgtcgtctggggtttgtcgctcatgatggcgatcttttgaccgatgaccctgtttaaaaaggtagactttcctacgttcggtcttccgatgatagatacaaatcctgatttaaagctttcgttcgtcatgtaaatcctccgatgaaaatgcgcccggcaataattcttccgcagtcatttcttttatttgtccttgtaagttggtcagaataacaagcatatcctttgagcacagctcggaaattacttgtctgcaggctccgcacggcgaaaccggtcccggagtatccgcagccacggcgagcatcgcaaattccgtatccccctcggaaacagctttgaatatcgccgtgcgttcagcacagttgcacatgctgtatgccgcattttcaatgttgcagcctctgtacacttttccgtctttggtaagaagagcggctcccactctgaaatttgaatacggcacatacgctgtgtcccgtgcttttaatgcttctgcaatcaattcttgtctgttcatgtgtacttaattcctctcttacctttatcctgtatgataccgctgtcacttttattttacataattatgatcggtttttcacgcccatttttggcaatgtaaaataattgtaagaatcttctgctaacatatcttcggcaggaagatgagtaaaccaatgatacacgatatcacggcaaagacgcaaacggctccggcggccgcgtcctttgccgcttttgcgagcgggtgatactgatcagtaactaaatccacaacatgctctatcgccgtatttaaaagctccaaagcaagcatccctccgatcagcaccaaaacaacggcccattcggctgtgctcagcccggtgagaaaaccgcaaacgataacggcgcaggccgcggtaatatgaaattgaaaattccgctctgaccgcgccgttttccagattcccctccatgcatggacaaagctcttcaggaacctgctccactcgtttttatgatctcgtgagtccatactcatccagcaaatccttttgctttgaaaacatttcttcctcttcttcttttgtcatgtgatcatagccaagcaaatgcaaaaagccgtgcacggccagaaaaccgagctctctcataaacgaatggccgtactcttccgcctgctctttcgttctgtctgcgctgatgataatatctcctaaaacaggcggcatgtcggcgcctacgatttccacctcgtcttcgccttcttcttcaagcgcaaacgaaatgacgtcagtcggagtgtcttttccccggtagtctctgttgatttctctgatttcttcatttgtcacaatcgtgaccgatacttcagcctgatcctgaacgccttctttttccgccgcgaattggagcagcttctccacttcttggagcgcatcagctgagacgctgttcgtttcatcaacaatatctatgagtaaacccatttatttcaccttcttcgtagcctccggatattcaatccgggagtggaaaattccttttaaagtcgcacatagtgttttggcgatcgtatccagttctcggaacgtgagatcacattctgagaattgtccgtcctgaagcttatcggatataattccccgcaccagtttttcgatccgctcgggattgggattatgcatggaacggacggcggcttcaacgctgtcggccactgagataatagccgcttctttcgattgcggcttcggccccgggtagcggaactctttctctgtaatctggtcgcccttttctttcgctttataataaaagaattttaaaagggacgttccgtgatgctgctccgcgatatccacaagctctttcggaaacttatagcttctgagcatattcgcaccgtctgtcgtatgtgcgataatgatatttttactgagctgaggagacagcttgtcatgcggattatccatattcatctgattttcaataaaatattgcggacgtttcgttttgccgagatcgtgataatatgctccgacccgtgctaaaagaccgtttgcccctacggcttcacaagccgcttccgacagatttgccaccatgacgctgtgatgatatgtaccgggtgtttccgttaaaatctttcgaagcaggggatgattcggattagacagttcaatcagcctcatcgttgaaagaatgccgaatcccgtctcaaaaaacggcatcagaccgataatcaaaacggatgaagcaagtcccgagacgacccccatcagcatcagcgttccgatttcaacaggtgacagcgccgtattttgtattaataaaagcgacagcacgataatcatattaataaatgagacgaacagtcccgcctgcaatatttttgatctcgcattgtgtttccccaaaaacagaatgcctgaaatgctgctgattaaatagtaaatgccgatgacgtaattaaatgttcccgtcacaccctgattaaacatcatactgccgcagatcgccagaatgatgcttcccaaaatggcgagcctttcattgagcagcagcctgattaaaatcgcgccggcggcgatcggcacaagatagccgatattggtgtattcaatcttctgaaagagactgacgacttccataatgacgagaataagcgttgtaatgatagaaaacagcaaaagagatttatttttcagcttaagctcctgctgctgtttctcaaaatagtagacaagcgtggcgataaacagcccgatcatcagaagcagaccgctgatcggctttaacaggttggaattattcaaaagccccgtcagttcaagcttcctgtatacttcccggtcgatcaggtcattctcttccacgagaacctgtccctgtttgatctgtaccggctggacgctgtctgacgcttcctggcgtttttcatccgtcgctttcggatcaaatacgtaattcggaatgaccgcgtattttccgatttcagtcgcagccgctaaatattttgacggcacagaagcgcttttcagctcttttgcgaccttatccttcgcttcggcaagcttttcagaaggaatttcactgctcatcaccgtattcaccgcggtaatgacggaatccctcacaaatgagaaatcttcattgtttgcatggagaagcgatttaatggcatcttccgagacggattcattgacatcctgtgtcagcttgtttttcaccgatttgaccaatgatttttccgaaggtgactttttgtctttttccgcatcttttttcacttcgccgatgctgtcaaaaatggaagtgatcaggtcaagccggttgtcggtatagccttttttcagggtgtattgatcttccaccgcatcttcggccgcctgttttttcgattccgtcgcctgctgatcttccactgtggcgggcgcgtaaatcgtcttatcactgactgaaaacaaatccaaattaagtgattcaggttttacatgaataaagagcaaaccaaacatgatcgctgaaagcagcaggtacagcagcacatgggctgagcgggcatgtctgaaactgcggaaccgttcccgggcgcttttgcccttttccttctttttcaaaacaagaacctcctccctgaaacatcaggaacacatcatataaaaatgacccgataacgggagatcgggtcatttttgcattacttttgcttatcataagcttcaataatttttgcaacaagcggatgcctgaccacatctgtctggtcaagttcaatcacggagatgccgtttatgtccttcagcatatccttcgctactgcaagtcccgatgtgacgcctttcggcaggtcaatttggcttacgtcgcccgtaatgatcattttagagccaaaacccaatctcgtcaaaaacattttcatttgagcgggagtggtattctgggcttcatcaagaatcacatacgcgtcgtcaagcgtccgccctctcatataggcaagcggggcgatttcaataacccctctttccataagacgctccgtatggtcgcttccgagcacatcatggagcgcgtcatacagcgggcgcagataaggatctactttttcctttaaatctccgggcagaaagccgaggctctcgccggcttccacagcgggtcttgttaaaatgatttttttaatgtggccgttttttaaagcatgcaccgcttttacgaccgccaaataagttttgccggttcccgccggcccgatgccgaacaccatgtcgtttttcttcatcgccgccacatattctctttggccgagggttttgacacggatcggtttgccttttgccgttttcgttatttcctcttcatacatgctttcaaaatagtccagttcatctttttttgccattttcacggcatacagcacatcacgttccgaaatctcgatccccttgcgaattaaagtaaggagcgagcccaataatctgtcagcgatctcaaatgtttcatcattcccggaaacgtaaatggtttcaccgcgcgtgatgaggctaatgcccagatccttctccattaaatgtaaaaaggcatcttggctgccgaacaaagaaagtgcttcgtccgggcttttcagtttgtgattaatcgcaagtaaatgttctgccattctttagtctccctgaacaataggtgtggtttgaacgatatcttctataacttggtagagaataatcaactttactttaccattctcaacggattggtgcaaaactttttcactttccacctctccgctgccgtttaatcgcttttctacatcttgtcttcccattttgataccggcctgaaccgcttcgcctttcgtataagtccgcacggttgtttcactttctcttgtctgttcttgaacgtaagaaatcggaagcttcatccccagaaattgaaacgggtgcttttcttcctctgttttcggatgtttcagcggctcctcattaaattcaaagccccaaaaaggcacgccccatgatccgaaagacagcttgtgcttcgtccttactttacccgtatatagcgtaaatgatgtttcaagaggcacggttacttctgacttgtaccatgtttctccgtaaatttccgcttttgaggcgactttccgatcttcatttccgatcagtcctgagacgagaagctgtcctttgtcaacatgatcgttcacaaaagccatcggctgccccttttgcacgaacatccttttgatgaccgccttctttttggcaacgatatggcgggggctcacgtacttttcttttgtcggttcgtttttttcgaccactttcatatgaagggctgtcccgttcaattccacaccgacccacgtaatattatcaatgccgtttgttaatgatttttgaattttctccggcgtcatcattaaaaattgcaaacgtccttttttcacaccgatttcttcaaggtgctttaccatctgatgctcggtttcgggcttggcccctttaatatcaatgtcccaaatcatgttggacaaaagaaacaatataacgaaaaacatcacaaatcccgcagtgaagcccaggtttaattttgatttgagaagcagaaagggaagaccctttctttttgtaaagcttgctttgcattcatgttttctgatgactcttctgaaagcatgtacatcttgaagctgaatcatcagcagaacacagtcttgcttttttttcaccgcaaagatggcgattccgtttctcgtgcattcattcagcaaccgttcaatcccttttcctttgacttccatttggactttacccgaaaaaaatgacagccatttgtttttcacattatttccccccggctttatgaatcgacatatcgtacgtgatctatcgtgccttccaaaagaatttcttcaggaaggattgccttaatgaccaagttttttcctgatatgatacattgcccctgcttgagcatcagcctgacttcttcttcgctgaacagcaggaggcctctgtgattctctatgtagatatgaagtctgccgaccatcgtaatccgaggcagatccatcataacgtccgggggaatttccaatgctcttgtcagccatgcctttacacgattctttctttgccccataaaaaaagaaccccctttcatctcatatgtatgatttgaaaaggggttctaacactttattttttaccgatgctccgcatggtccggtgcggtttttttgcacggggcggacccaaaacctcactgaatataatgccttgaaccgcagtttctttatttattttgagggctgatttcttcagagacgcgtttcgtgcgcgttgagatgtcagcttatgttcaagcccgttaaacatctgctccgtctccgctaggcgcttttcagcttcccttcttttttgctcaaaagggttctcttctgaaacggcaggcaattcttccgcttccggcttatgctctttctgcggctgtttttgatcctgcttttttgtctgattttcggggcgtgtacccggcggccgtttttcatctttgtttttcttgccgaatattgccgatataatgccgatgacggcggcaatgacgagcggatttgtcagaatctcgtgcatatagcggctccctccttaatagagaggttattgttggtcttcatcttgctggtcattcgtcagcttgccgatagaatccctcatgtccgtatccgcgtcgatattttttatgttcatatagtccatgacgccgatgtttccttcacgcagcgcttctgccatcgcaagcggcacttcggcttctgcttccacgacttttgcacgcatttcttctacgcgagcgcgcatttcctgctcttgggcgaccgccatggcgcggcgctcttcggctttggcctgcgcaatgtttttgtctgcttctgcttgatccgtttgaagaatcgctccgatgtttttgccgatatcaacgtcggcgatgtcaatcgaaagaatttcaaaggcggtgcctgaatccagccctttgccaagtacggtctgcgaaatcatatcagggttttcaagcacttttttatgattacccgaggaaccgattgtcgagacaatcccttctccgacacgggcgacaaccgtctcttctcccgctcctccgacaaggcgctcgatattggctcttacggtgattctggcttttgcttttacttcaattccgtccatggcgacacccgcgataaacggtgtttcaatgaccttcggattgacgctcatctgcacggcttccaatacgtcacgcccggccaggtcaatggctgcgcagcgttcaaatgtcagctcaatattggcgcgctgtgccgcaatcagggcattgaccaccctgtcaacattaccaccggccagataatggctttcgagctgatttgttgttgcggataggccggctttgtgcgctttaattaacggattgacaacgcggcttggtatgacgcgccgcagcctcattccgaccaaagtgaaaatgctgattctgactcctgccgcaagcgccgaaatccatagcatcaccggtacaaaggtgaagaatatggctaacacgattatggcagctgcaactattgctaaaatcgccaaacttgacagttccatctaattcctcctcaaggttatcatctatatttctctcacgacaatgcgtgagccttccgctttcactactttcacctgtctgtctttttcagtgaatgatccttccgagacgacatccagacgttcatcatcaataatgacggtgcctgacggtctgagggctgtagcggtaatgccgactttccccaacagctccgtccggttctgatttgaaacataaccgctctccgtgcttgttgaatcagttaatattaattttttaaagaatttcattcgtttccccaacacccttgttaatatgataaaggctgtaatagacacagcaatggcgatcaagagagaaaccgccattacggtaaagctgcccgcagcgagaaagaggctcgcgatgacgcctgcaataccgataagaccgattatgcctccgggcagaaatatctctaaaaggataaaaaccaagcccgcgcaaaataagaatacgctgtcatagccggcgaatccggcagcgatatgcccggtgaaaaacagcagcatggccgtcagtccgacggcacccggtattccgaggcccggcgagaacaattcaatggtcaaaccaagcaaagcaagcgttaataagacggggacaacaaacggatttgtcagccatctgcccaatttgccgacaaaaccttcttttgcatggtgaacatccgctttgtcaaaaccgagctttgtatataaagcatcaaggtctgaaaccgtgccctccgaatatccgacttccttggctttttcagctgtcagtgtcagcagttttccctttggggcgcccgcttcctttgcattgatggcgggatctgccatggccagggcgtatttcggatttcggttgtttttaaccgctgcgtcctccatttctgcatgccacagtgattgagcctttttgtccgccgcgtttccttttccgtcgatgatggctgcggcacccatttttccgcccggcgccatatagatttcatctgcctgaagcgctatatacgctccggcagaaagcgcccgtttattaacgtaagcggtaacaggcacatccgcgcggccgatgatatccgcaatatccaaggctgattgaacggcgcctcccggtgtattgatgtcaagaataatgtgtgacgcgccggactccttcgcttctttgaaagaacgcgataaaaacgaggcgagcccctgttcgacatttttctcaaccgggatgacataaaccgatgggtgatcagctttcgcgttcaattgaacccctaataaagataatacaaataagcccaatagagcaacagcaattccgtttttttttcggaacaaggcaaatataccctccttcccgtttcgttcttctttatatacgtaacaaatgtactttagtttcatttttttatgtataaaaaaagacatctctctaggaaagatgtcttttttcttgtcaattaagataattgactgctgacaagtctgttaattacactgccgtcagctttaccttttactttaggcataatagcactcatcactttgcccatgtccgctttggagctcgcaccgacttcagcgatggtttcatttacaattgtctgcagctcttcttcagaaagctgcttcggtaaataaatttctaaaatgtccagctctttttgaactttatctactaaatctaaacgatcagcgtttgaaaattcatggagggagtctttacgttgcttaagttcacgagataggacagtaagttcctcatcctcggtcaaactgtctttcttaagcttaattgcttcgttttgaagtgaagctttcaccattcgaacgacagtcagtttgtctttctcacggcttttcatatacagcttcatatcttggttaagtcgctcaagaagactcataaatccaccctcttttagaatttgcgttttctagcagcttctgactttttcttgcgctttacgctaggtttttcataaaattcgcgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaaaaagatacatatataaacatgtactttgacattataatataagccatcagtcaggtcaactaagcgagctcacttttccgtcatgaataaggctgcttgtctatataatgatggaaaggggtgtttcgtttgataatactgattctctttaccgcacttatcctggtttttttactcggaatgagcctgctcaggcagggcctgatcgcattaacgtattcaaaaattgagaaaagcctgctcttatttaccgaccaccctttgaaagcttttctcataagcatcgtattcaccggttttcttcagagcagctcagccttcatggtcattgtcatcggctttgtcagcgcaggcgctttatcttttaaacggaccattccgatgattctcggcacgaatgtcggctccacgtttacgacggagtttttagccataaagatggatgtgctcatttgggtgctttttatcggaggccttgtgtttatcctcatccgtaaatatccgttcaggcagatcggtataagcttcctcggtctcggcatcatctttttttgcatcacatgcttcagccggcttgccgttccgctgacagaaatgaaggcggggcggaggttttgcgccatgtgaatgattcgagctggtccgctctttttatcggcatgatattgacggcaatcattcattcaagctccgtctgcatcggcattttgatgagttttatgaacgaaggggtgatcggcattgaacaagcggtcagcgtcgttctgggatctaatatcgggacatgcgtcacggccgtcatggctgctgtttcaggcggttatgccgccagacagaccgccggtgctcacgtagtgtttaatattctcggcgtgctgctcgtctttcccttcctgtctgcatcagcaggtattacggagcgcctgtctgatgatcccgcgcagatgattgcgcatttcagcctgttatttaacgtagtcaccgccttattgtttctgccgttcacacatttgttttaccggctgattgacaggctgattcctccgaaaccgtaaaaaaaccgatgcgggaaggcaccggtttttttatctgttatgaagacatgcgcatgtttcgggtcatttcatcctcaacgacgcggacgaattgtccttcgttatacggatagcccgctttttgaattttgactttgacaagtttgccgattacatcttccgtgcctttgaagacgactttcatgtaattgtccgtatagccgacgaacatgccgtcctcatcagactctttaaacgcctcttccggaatgatttccagaacctctccttcataatcggaggcgtattctttggcaagctggtcagacagcgcaatcagcttatgcacccgttcgtttttcacgttttcgtcaacctggtcttccattctggccgcaggtgttccggtgcgtttgctgtaagggaatacgtgaagctctgaaaacttatgttctttaatgaaccggtatgtttccataaattcttcttccgtttcacccgggaaaccgacgatgacatcagatgtgacggcaagacccggcagcgcttctttcagcttatttaaacggtccgcgaaaaattccatcgtatatttgcgtctcatccgtttcagaacggtgtttgatcctgactgaatcgggatatgaaggtggcggacgattttatcagacgcatccagcacttcaatcacttcatcagtgatttgacttgcttcaatagatgaaattctgatccgcttcagtccttctacacgtgtatcaagctcgcggagaagcttggcgaaattataatctttcatatcttcgccgtagccgcccgtatgaatccccgtcaggacgatttctttatagccggcatccaccagctgctgcgcctgtttaatgacttcttccggatcgcgggaacgaagcaggccgcgcgcccaagggataatgcagaacgtacagaagttgttgcagccctcttggatttttaacgacgctcttgtgcggtcagtaaaagcgggaacatccagctcttcaaacacgcgtgctttcataatattgccgacgccgttgatcggctgacgctcttccctgtactgctcaatgtaaccgagcattttttcacgatcctgcgtgccgacgacgatgtcaacacccgggatggccataatttctgccggagaggtttgcgcatagcaccctgttacgcagatgacgccgtcaggattttggcggatcgcccgtctgatgacttgacggctttttttatctcccgtgtttgttaccgtacatgtattaatgacatatacatctgctgtctgttcgaattcttttcgttcataacccgcatctttaaacagctgccagattgcttctgtttcataatgattgaccttgcagccaagggtatgaaaagcaacagttgccattactgatcacctcttaataactctgtatgataggaaactgcgcttaacgcgtaaagaggcgcagtttcagtccgtaaaattctcggtccgaggccgcataagacggcgcctttttctgaaagctgatgaacttcagactcagtcagaccgccttcagggccgaatacgattaaaagagacgaaccttgcggaaggcttttaagctccgcggcgaaagcgcccgtttctccctgctttgatgactcctcgtatgcaacgacacatttatcgacattctccgccatttcaagcagctgccggaacgtatgaacggttttcacttcgggaatttcattgcggtacgattgctccgccgcttccttcgcgattttcgcccatctctcccgctttttctttgcctttttgtcgtctagcttaacgacggatctggcgccctgaaaggggatgaacatactagcccccagctcggtccctttttggataatccattcaagcttatcgcctttcggaaggccgctggcaatcctgatttttaacggcagttcacggttttcacccgtccattcagcaatgctgcatgatatatgatctttagaaaccgctttgagcaggcataacgcttcatggccgtctttcgaacagcagattatccggtctcccgcactcattctcatgacgttcgctatatggtggacgtcttcccccgtaatttgaaaatcgggagtttcgtccatctcctgcttcgtgagctcgataaaatatcgttgcatacgctgtgacacctactaactgttattttttcgcgatgatgctgacccaatcttccatagacagaatttctgtgatggtaaagccggctttttccaacgcttcttttacttcctgttttttctggccgataatgcctgaagtaataaaatggcctccgtctttgagcaggtcatacgcctgtgatgtaaagcggagaatcacttccgccagaatatttgcgacaatgacatcatgttcgcccgtgatgccgtctaacaaattgttctgcttcacttcggccgtatcactcactttgttcaattttagattcagacgcgcgctttcaacagcgaccggatcaaggtcatacgcatgaaccgattcggcctcaagcatggcggccgcgatgcttaaaattcctgaaccggtgccgacatcaatgacacggtcgcctttttgaacgatacgctcaagcgcctgaatgcacagaacggttgtcggatgcgttcccgttccgaatgccatgcccggatccatttcgataatcagttcatcggtattcacgggtgtgtacgtttcccatgtgggtacgatcgtgaatttttcagaaattttcaccggatgataatactttttccaagctgtcgcccattcttcttcattaacttcagaaatggtgattgtgtttctgcctaaatcaatgtcgtacaaaagcagattatttatcgtctctttaatgccgtccaccgtttcgccgaggaaactgttaatcggcagatacgctttgacaatgacaccctcatcggggtaatcattggggtcgagctggtagatttccccgtaaacattctcacgctctttcattaaatcaagcggatcttcgatgacaaccccgctcgcaccagcttcatgcaaaatatttgagatgggttcgaccgcttcatgtgttgtgtgaatgctgatttcggaccatttcaaaactaccaactcctatccaatcattactcgcctttaaatgcgcgttttactttgtcaaagaaactcatttcttgttcatccggcaggtttccgctgacttcagcgaactcgcggatgatgtctttttgtttgtctgtcagattcgtcggtgtgacgacgcggacgacaatgtgctggtcgccttgtccgtagccccggacgttctgaacgcctttgcctcttaatctgaatttcgtgccggtttgtgtgccggcaggtattttcaatttcacttttccgtgaagcgtcggcacttccacttcgtctccgagtgccgcttgggcaaacgttaacggcatttcgcaataaatatcgtctccgtcgcgttcaaagaactcgtgggcgcgcacatggaatacgacaaacagatctcccgcaggccctccgtttacgccaggttcaccttgacccggaacgcgcagctgctgtccgtcatccacaccggcaggaatcgtgacattgatttttttccgttttttcactttgcccgtgccgccgcagtcagaacacttgtttttgatgatttttcctgttccttcacagtggtggcagactcttcggttaaccactttgccaaacggcgtgttctgttcgacgttcagctggcctgaacctccgcagtgcgagcacgtatccggctttgttcccggctttgcgcccgatcctttacatgtttcgcaattctcttcgcgcggaatttcaatgatcgtttcttttccgaaagccgcgtcttcaaatgacagggtcattgtatactgcagatccgcgccttgccgcggcgcattcgggtcacggcgtctcgtgccgcctccgaagatgcttgagaatatgtcatcgaaaccgaagccgccgaagtctccgccgcctccgaaaccgccgccgaatccctggttagggtctgtatggccgaattggtcatattgagcgcgtttttggtcgtctgagagcgcttcgtacgcttcttttacctctttgaatttttcatctgctccggattctttattgatatcaggatgatatttttttgaaagcttccgataggcttttttgatttcatcctttgaagcgctcttacttaccccaagcacttcatagtaatcacgcttactcatctcgcttcactctcccgaatttctcacataaattagattgtatcattttgaattatgttttttcaattccttttatcccgggcaagaaaaaaagtcaaagccaagagatgcctgactttgactttctgtctgttgaatcagaatatgctgtgtgttcttccgcctaaagccatgcgggaaagaacttattttttcgtttcgtcgtcttttacttcttcgtattccgcatcgacaacgttgtcgtccgcttttttgccttcagcgtttgctgcgccttcagcctgctgcgcttttgccgcttcttcataaagcttcatagaaagctcttgaacgattgtttgaagctcatcttttttcgctttgatgtcttcaatttcgtttttctcgatagcggctttcagcgcgtctttcgcgtcgtttgcttttttcacttgctcttcgtccactttgccttccagatcttttaatgtcttttccgtttggaacacaagctggtcagcttcgttgcggacttcgatttcttcttttctcttcgcatcagcgtcagcgttttcttccgcttcttttaccatgcgttcgatctcatcatcagaaagacctgaagaagatttgattgtaatgttttgttcttttcctgtgcctaagtctttcgctcttacgtttacgataccgtttttgtcaatatcgaaagaaacttcgatttgcggtacgccgcgcggtgcaggcgggatatcagtaagctggaagcggccgagcgttttgttgtccgcagacatcgggcgctcaccttgaagcacgtgaatgtcaacagccgtttggttgtcagctgcagttgagaatacttgagacttgctcgtcggaattgtcgtgttgcggtcgatcagtttcgtgaacacgccgcccattgtttcaataccgagagaaagcggtgtaacgtcaagaagaacaacgtcttttacgtctcccgtgatgacgccgccttgaatcgctgcacccagcgctacaacttcatcagggtttacgcctttatgcgcttctttacccgtttcttttttgattgcttcctgtacggcaggaatacgtgttgatccgccgacaaggataactttgtcgatttcgctcgcagaaagatccgcatcttgaagagcctgacggacaggagccattgtgcgctcaacaaggtgagcggaaagctcttcgaatttagcgcgggtcagtgtcagctcaaggtgaagaggacctgcttctcccgctgtgataaacggtaaagaaatttgtgtagatgatacgccggaaagatcttttttcgctttctcagccgcatctttcaaacgctgaagcgccattttgtcttttgaaagatcaatgccgttttcttttttgaattctgctacgagatgatcgatgatgacttggtcaaagtcgtccccgccaagacggttgtcaccggcagttgaacggacttcaaacacgccgtcgccaagttcaagaacagatacgtcaaacgtaccgccgccaaggtcgtaaacaagaatcgtttggtcttcgtccgttttatcaagtccgtatgcaagcgctgctgcagtcggttcgttgataatacgctctacttcaagaccggcgattttaccggcatcttttgtcgcttggcgctctgcatcgttgaagtatgcaggaaccgtgataacggcttttgaaactgtttcgccgaggtagctttcagcgtatgctttcagatgctgaaggataatagctgacacttcttgaggcgtgtagtcttttccttcgatttccactttatagtcagtacccatatggcgtttgacagacatgattgtgttaggatttgtgattgattggcgtttcgccacttcccctacttggcgctcgccgtttttaaatgcaacgactgacggagtcgtacggtttccttcagcgttggcgataactgtaggctctccgccttcaagcactgccacacatgagtttgtcgtacccaagtcaattccgattactttactcactttgaattacctcctgctatgtagttattgattcacttttaccattgaaggacggatgacgcgatccttcagtttgtagcctttttgcagttcttcgataacaatattgctgccgaagttttcatcctccacctgcatgacggcttggtgaaggttcggatcaaattcctgaccgacagcttcgatggcttcaacaccttctttttcaagtgcgtccatcagctggcggcggaccatttccataccttgcagcaagctttttgtctgctcgctttcagcttctacctgtaacgcccgttcaaagttgtcgagagccggaaggatttccgttacgacgttttgagaacggtatttctgagcagcttccatttcaaggcggctgcgtcgtttatagttttcaaagtctgcttgaacacgcaaaagcttgttttctttttcatcaagcaaaccctgcaattcatcaatttggtgctgaagggcttcttcctgacctgccgtttcttcatgctgctcttgtgaagccgcttgttctgcctgttctgtcacttcttcttgttctgctgcttcaacctgttctgcggtttgtttttcttctgacattgtgttcacctccctcaaatgctgtaaaaagatgactgaaaatgattgccaaaattcccttattcatcatacaaacttgtgaatgcttttgacaagtccgaagtcacgtgctgcagcaggctgacgactcttgaataattcatgcgcgtcggcccgataatcgcgattgatccgatctgcttcgtatcaactgtataggtggccgtgattaagctgcagttttccatttcttcgtagtcgttttctttcccgattttgattgaaatcccggcttttgatgactgaaacagcttcagaacatcctgctctttttcaattaaagataagagcgagcggaccctttcaatatcgtggaactccggctgattcagcatgttgatctttccgccgaaaaacaatttctcaacgtgggccgccggatggaatgtggagcggagcgattcaagtatgctgtcatagttggcgatatgctgccttaaatatgtgacaacctctttaaaaatgcgctcattcagttcgtccatcggcacgcccgctaatcgatcgtttaatatattgaccagtttttcaatatcggccaaatccactttagccgggaaattgatggtgcggttttcgacatgccccgtgttcgtgacgaggatggcgaccgccttatccggctggatcggaacgatttgaatctgtttaagatagttctcgctcagcgtcggcccgaggacaatcgatgtgtagtttgtcaggtcggacaggatttgcgctgatttttggactgttttttccagctcgaagattttttctttaaatatcgagtgaattaaatccagatcggtttttgtcagcttgacgggtgacagcaaatgatcgacataatacctgtaccctttttccgacggaatccgtcctgaggatgaatgggttttttcaataaagcccaattcctccaagtcagccatctcgtttctgatcgttgcagagctgaatgtaatctcgtctttttttgaaagagttcttgatcctacaggctgcgctgattgtataaaatcattaataatcacttgcaggatcaacagctgacgatttgttaacatcatcatcacccctgttagcactcaaggtcagcgagtgctaattctatatcaaaagtaacaaaccaaaagaaaaatgtcaattataactcacccaaaaaagcgccaaaaacctcatttcctaataatttgccctcatgcgttaatgcaaccgattcttccgtgtcacagatcaggcctttttcggttaaatctttgagaacatcgggaaacagttcgtcgaccgagcgtccgaatttatcgagaaaagcttgcttttgtacgccggacatttttctgagaccgaggaacatttcttcttcaatctgctcctcccgtgtcacctcgtgcgtgtcacggtaaggcagtcccttttcttcgatgagctgaatgtaatgtttcacaggcccggcgttgacggtgcgcgtgccgctgatatacccgtgagcgcctgcgccaaaaccgaaatacgcttcattgctccaatacgtcagattatgctgcgactcgtatccgggctttgcaaagttgctgatttcatattgacggatgcccgcttcactcatctgcctcatgaccgtttcatacatctcggcctcttgttcttgcgccgggagatgcaggcggcctttttgcattaaattataaaacaccgttttcggctctacgatcagcgagtaaacggaatagtgctccgcatcaagagacaaagccgttttgacggaattgtcaagatcggccagcgtctgacccggcaggccgaacatcaaatcgagactgatgttgtcaaagccgagagccctcgcacgttcaaaggaagtgaatacgtccttttgtttatgcactctgccgattttttgtaaaagctcaccttcaaaggtttgaacaccgaagctcagccgattgacaccggcatttttcatgatttttaatttttccggggacaaatcatccggattcgcttccgcggcaaattctacgagtccgtcagaaggctccagcacgcggtgaatggaatccatcaatttttccagctgggcgggtgagagcgatgtcggcgtgcctcccccgatgaaaatcgtgcggagatcagggcgtcccgtccgttctattgtatttatcatttccttttcgagtgagtttaagtacttatcgacaggctggctctgaataaaatatttattgaaatcgcaatagtggcagatatgctcacaaaacggaatatgaatataagctgatttcattttgaaacaccttcttctttacagaaagaagccgcagcgcgggactgcggcggcttccgttattttttcgggctgtcatccattttaagaacggccataaacgcttcctgcggcacttctaccgagccgacctgcttcatccggcgttttccttctttttgtttttcaagaagcttccgtttccgcgagatgtctcctccgtaacattttgcaaggacgtttttccgcatggccttaatggttgagcgggccacgattttctgtccgatcgctgcctgcacgggcacttcgaattgctggcgggggatcaattctttcaatttttcgacgatgactttcccgcgctcgtatgcgtaatcgcggtgcacgataaacgacagcgcatcaattttttctgcattcagcataatgtccattttgacgagtttggacggtttgtagccgatcagctcgtaatcgaaagaggcgtaccctttcgtgctggatttcagctgatcaaaaaattcatatacgatttccgcaagaggcatctcatatacaatgctgactcggttggcgtctaagtactgcatatcgataaagttgccccgtttcccctgacaaagctccataaccgctccgacgtaatcgttcggtaccatcatcgtcgctttgacataaggttcttccacccgctctattttctgcgggtcaggcatgtttgacgggttatccacgatgatcttttcgccgtccgtcatataaacgtcataaataacgctcggcgcggtcgtaataaggtcaattttaaattcccgttcaatccgctcttgaatgatttccatgtgaagcattcctaaaaagccgcagcggaaaccgaagccgagggcttgtgacgtctctgcctcgtattgaagagatgaatcgttcaattcaagtttttccagagcttcgcgcaaatcattatatttggctgtgtcaatcggataaagtccgcagtataccatcggattgagtttgcggtagcccggaagcgcttctgccgcaggcttaaccgcgctcgtgatcgtatcaccgacacgggtgtcgccgacgtttttgattgcggctgtcaaatagcctacgtcaccgactgtcaattcgtcagccggctgcgctttcggcgtgaagacgccgacttcgatgacttcaaactcttttccggttgccatcattttaattttctggcccggtttgaccgttccttctacgactctgatatacgcgacgactccgcggtacgcgtcataaagcgagtcaaagatgagcgctttcagcggagcttccggatctcccgcgggagccggcactttttctacgatctgttctaaaatgtcttcgatgccgatgcccgctttcgctgaagcgaggacggcgtctgaagcgtcaaggccgataacgtcctcaacctcttgacgcacacgttctggctctgcgctcggaagatcgattttattaatgacaggaagaatctcaagatcattatcaagcgccagatagacgttcgccaatgtctgcgcttctattccctgagccgcatcaacaacgagaatcgcgccttcacaggcagccaggcttcgcgaaacttcatatgtaaagtcgacgtgtccgggcgtgtcgatgagatggaatatatattcttctccgtcttttgctttgtatttcagctgaacggaatttaatttgatggtaattccccgttcgcgttcaaggtccattgaatcaagcaattgttctttcatttcccgctgggtgatcgccgatgttttttctaaaatccgatccgccaaggtcgatttgccgtggtctatgtgggcgatgatggagaaattccggattcttgactgcctctctaaacgcttttctttatctgtcacaatctatcactcctactattaaacgcaaaatacactagcttagattatatcaataggattgtaaacattcaattaaaacaagaaagagaaaagcttcctttaaggaatcatccgcttttctcttcatcaatgctaacggttcagtttcgaaacccactcatacatcgcctgtgccgagtccgtcacggtatttgaaagggtttctccggcttttgaaaacaggttgaaggtttctgcctgttccagctgtttttgtttttcttccagatctttcgccgtaacggtttgccccaaaatggaagcttctttttcctgtccttctccgccgccgagcgtgaatgctccttttaaggagggatctttgtatcctttcatatcaagcattccgctgtttgcctgctgcatgccgaacaatacgccgacaaacatgacaatggcgatcagcaggcatttgccggtaaaacggatcatttgcatcacctgatttctattgttttttcttctctcctgattgcgagctgaccttgtctgcatcccagtacagttcgctgaatacatcggccacggcatctgatgcgcgcctcagttcttcaagattgttatccacgccccgaattccagcagaagcgaccgatcgtttaaatcctggttgtacactccattatctcccggagagccttttgataaaacaccgacgcttaagcctgggtattttttctccatcagcttatgaagttcacttgcgagtttatagttttcttcaaaattagcgctttttttgccgacgacgatggcgaccctggcatagctttttcctttgatgtcggctgtcgtatttttcttgcggcgggaatcccggtgaatgtctatggtatattgcaggtttttatttttggcgagcgcgctttttacgaccggccttgattcgtcgtagcttcgcgcataatttaaaccgtctttgttcaggcgggcctgaatgtcggttttatctacggtcgctcctacaccttgcgcttcaagcgcttttccgaacatatctccgacaagcgtgacattggccttcgaatggcgggcgttatccggatttgtttccccttttaacagaggaagataggattcggtattatgagtgtggtaaataaaaacgacttttttgctgcctgttgaatgtttcggcggcgccttttcttcttttttcgttttgttttcgatttctgccaggttcacttctttttctttttccatcacctttgacggcggcggggattcagcaggcatattcgtataatcagtcccctgccccgccagaaggatctccgtatcgtattgggcaaatcccggcagctcacgtcccaagaaactccgcgggtcttccatattaatgcttgtcgccagttttaaggaaagccgggacagctgaaaagagtctttttcaggaagctctgaggcgaaataatgattttccataccgaggaggtgtgcaaacgcgtcacccggaagttctccggcaattccgtgaagagaattcgaagaaagcctcagttcagggcgaagcgatgtgagcacacccgataatacgaaaataacgataaggcttgtcataaacaaaaacatgcccttgagcgcatttccaccgtttactgcaacgacaatttgacggtttctgcgtttttttctcatgatttgaatccctccagcgcttgtctagtaattactctatgaacaagctagaggaggtagaaccattttaatgattataagaacctttgttatcttgtgacactttttcatgaagggcggtgtttaacccgtttgcaagcacgttcgccatatcatcaataaaggtgtcaatctccttcggtgtgaccatcagattatggccgagcggagagagcacttcgtgaatcagctggcgtttttcgttttcgtccagtgtgccgacaataccgagaaaggattggcgttctttttctccgggaaggtcttcgtctgtcagcaccttctttttgccgaagttcattccggcgggcaccagagatcttgacgggctgtcatctttcatctctctgccgaaatgctttaatatataatccaccgtatcgctcgcgatcgtaaccgcatcaacgacagtcggtaccccgattgcgatgacggggatgccgagcgtttccttgcttaattcttttcttttattgccgacgcctgatcccgggtgaatgcccgtatcagaaaattggatggtcgtgttcaccctttcaacggctcttgccgcaagagcatctaccgcaatcacaaaatccggctttgattctttgatcacaccttgaataatatcgctcgtttcaattcccgttaatcccatcacaccgggagcaagcgcgctgaccggcctgtacccttcctgcacgttttccggctgaagcctgaacagatgccttgtcacaagaaggttttcggtcacgagagggccgagcgcatccggcgtcacattccagttgccgagaccgacgatcaaacagcttgcatcctttggaatctttaatgccgacagataggcggaaaattcctcggcaaacacttccgttactttttcctgcatgtcagagtcgtgttcccgaaccccttgagcctcgatcgtgacatagcgtccctgctttttccccgatagctcggcgccttctttggtaatatcgacggttctgactttaatgccgcccttgtcgcgttctttttcaataaacccgtttatttcttttgtctgaccggcttgtccgtcttttaccgcctgtttcgtttctaccgctaaatccgtccgtatcagaaattgattgacatccagttcgttgtttttcacaggaaagacctccttcaatcatcgtggtacatagtgtggccatttacaaaacgaatcatgcgaatttacccatcaacgaaaaatactttacatttatattgcaatctaaagttctgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgctcataacgcgacaatcaaatctgctatgcgtactgcaatcaaacaagttgaagcttctgttgctaacaacgaagcggataaagcgaaaactgctctttctgaagcagcgaaacgcattgataaagcagtgaaaacaggtcttgtacacaaaaatgccgcagctcgatacaaatctagacttgcgaaacaagtgaacggactttctgcataatacaaaaacgatccctttaacggggatcgtttttttcattcagtccggagaagctcaaggagaaagagctccagcaagagctgcttgtcctttttccccgttttcatttcataatccattactgcgagcctttctataatacgccgcagctcttcttcagaaaatagcctcgcctgatccatcgccagctttacccggaaggggtgcacctttaagttggaagcgatttgcttttggccgtatccttgtcccgcaaaatactttgtctgcataatcagacggaattggttggcgatcagcgccataattttgatcggttcttcgttttgttttaaaagatcataaaatatttgaagactttccgtccgttttcggttcacgattttgttgatcagctcaaaaatattctgctccaaacttcttgcgacaagctcccggacatcttcaagcgtgatctcatgtctgtcaccggtgtaggcggagagtttttgtatttcctgatatatggaagacagatggccgtttgcaagcagaaccaaatgctcggcagcttctgtatccatcgttttattttcggatttcgccagattaatcgtaaaatcagtcgtctcctttgcattcagctccttagcttcaatcataagggctttttgcttcagcgctttcgtcagctttttccgttcgtccagcttttcatacggagccacaatcacaaagaccgtataaggcgcaggctccttcaggtaagtctccaaagcgcttgtattatgctctattttttctttctttttttcccctgttaaaaaagacggattttttacgataaccagccgcttctctcccataaacggaaacgtttccgcatcggttatggcctggtcaagcggatcctcttcaagatcaaaaacagacaggttaaaatctttagtctcctcatcaacgacagcttgtctgatccggctgacagtctcttggagcagatacgtttcttttccgtataagcaataaacggagcggacatccccttttttcagggctttccaaacatcaaataccatgatcgtatgacttcctctctttcttgatccccttctatcctaaattgagttcggcaaatagtaaagaggaagctttaaaaaggacagcttcctcatttataataaacgcctgattcacaagctcccgggtctgcttgtaaaaaggcgataatcacaagaacagaaaacgttaccatcacttctagatttttcaaaacaattccagtatacttagggaagtcaggagggatgaaattgaatgattttgaaaaaaacgttcaaagcaaacgaaatgatgctgttgactcagctgtcggttttgtcgtgtccttcggatttttcgcctttttgttcgtgatggcaacagccatccatcttatcggctcttagccgcattccgggctgctgtcaatcggcagtcttttttacttcttgcgccctggtttcttctatatcatatggagggaagacggaaaacgttccggcgcctttttcaaatctgtattgaatcgttccgctgatatcggtgcgaagcacattgacagagtacgccttcaaacgatccagcacttcttcgtgcggatgatggtatcgattctcttttcctgctgaaatcagcgctgcttccggctgaagctgtttcaaaaaggcttcactcgttgagcttttgctgccgtgatgacccgccttcaatatatcagccttcagtttcggatacgttttcagcacttctgtttcgccgtccgattctaaatctcccgtcaaaagccagctcactccgcctaaaaccgtccaaagcaccagtgacgaatcatttttactctttccgtcagacgactccggagacagcacctgaaactgaagatcaccggctgtaatggtgtcgccccgctttgcttcggcaacgggaatgttgttttctttcgccatatttaatatgttctgatccttcggttcttttacgaatcccacggggacaattaaccgtttgactctatgatttttgattaacactccggcttccccgatgtgatcctgatccgcatgggttaaaatcagcgcatccagctttttcaccccttttccgtttaaaaacggaatcaaaaccttctcgccgatagaatacgggtggcgtttttctttccatgattctccgggataagcaatcactccccctgtatcaaccattacggtccctttgcggtgcggcgcgtttataaacagcgagtctccctgcccgatatcaagcatatccgcttctccccatgggctgaaatacggacggcatattaaataagccaaaaccgcgcagaaaaaaagagccgatttcctgagttttaaaaaacctcccttttctaaagccgcaaaaagcgtaaaaacggaaaccgcaagcagaagaagggaaagaaagtcaggctttaacacaatcatagtaaataaatcaacggatgccgcatatgtaatgaaatcatgcacaggcttcatcacaaggtcaaacatattaaacaaacattctcccatctgccttgaaagtaaaagaagaaggaaaccgatgacagaaaccggaatgacaaataacgtataaaatggcaccatcaccatattcatcggaaaactggcaagtgaaatttgctgaaaatgatagagaagaaacggaagtgagctgagctctgcaatgaatgaagccatcgcaagcccggcaagtctgcttttccctgctttctttaaaatggaggatgacagaattaaagaggcgcttaccgcaaaggaaagctggaagcccgcctgccaaaggaggtaaggattaaacagcaggagcagcagataagacagagacaatgcagcagaggaatgaatgccgcgtttaacaagagttccggcgatataaaatcccagcatgagggatgcgcgcaatacggatgggcggcaccgctcagcagcgtatacaccggtaaaaacagcagcagcaatatccccgccttttctcttgtcagcccgattctgatcagagcataaaataatcccgccgttataagaccgacatgcattccggaaatcgccattaaatgaacgactcccaaattttgatatgcactcagtatatcgtcttctatagaaaatctttcacctaaggtcagcgcttcaacaattccggcggaagattcaggcacgtgattccgaatgatcgaaatcaaattttttctgatgctcagcagtttaaacagcggctgtttggatttttcacactgctgaatggaagtcacggtaaataaccagtgaatctgctgagagtaaagatattccttataatcaaaacccccgggaatcgtcgcatgtgcaggctgttccagagagcctgtaaatgtgcagcgcatccccggttcaagctgttcaatgcgtctcttttcttcaagagaccggattttgtacgaagccgcccatttttccttgtcatgtgtacggataacggctgacattttcgctccgtcaaccttcggaatattagtgatgacggcctgttcagtataactgccggcctgataccgcgttacattcacagcgtcacaaaccgtataaagaaagaaataaacacaaaaagaaacgaggcagatgataaccggagcaggctgctttgtttttatcataataaagagaagatacagaagaaaaaggagcagaacccagaagacatgagcggcggcaatccccgcagttgcagaaaccgccgccagaggcagaagaaggtatttatatttcatttatacgtaactggtaaacagctcattggcctgttcatgaatttttttcagttcatctgccttaactcccgcatcagataattgctgaatcagacctgcgacaaaagacaatttttcgcggtttttcagatcgatgatcatttcatcaagttcgacctgctccaccttgactccggcttggctgaacagctcttttgcataaggctgtgttttgtaatcttcggcataatagaccgttttgatgcctgcctggataattgatttgcagcattgaatacaaggataatgcgtcacataaatttccgcgccctccgtcggaacaccgaacttagaacattgcagaatcgcattcatctctgcatgtatggtcctctggcaatgattatctattaaaaggcatccttcatcagcgcaatggacgccgccggcgattgagccgttgtatccgccagcaatcatccgcttatctctgactacggttgccccgactgacagtctcggacatgtgcttctcagcgccagcaaatggctttgcgccataaaatattgattccatgagattcgttccacaagtgttccctccaaaaagtcttgttgcttttctaagtttacatagatttaagcagaaccgtcaattcactttaccgtaatggaagtttttatccgctcaaatgacttttctccaaagcctgatacattcatcaaatcttcagcagtctgaaaccgtccgttttcttctcggtaggcgataatagcttccgcttttttctgccccaccccggaaatcgcctgaagttcgtccagagatgccgtattgatattgacagctgcattctccttttcaccaactgctgttttcgggcgattctcctcttcgccttcactcggaatataaacaatcgtcccgtcctgcagctgctctgctaaattaacattcaattcatccgcctttttcttcaggccgccggctttttcaatggcttgcgtcactctgtctcccgctttcatttcatacacgccgggatttcggaccgctcctttcacatcaatcataatcttatcgtctgcggtgtcttttttgtccgcgacggatgcggaggctgtttgaccgagcacggactgctgtttgaccggctcttccttttcagaacgaaacagccaaatacagataaaaaccgcacctgccgcaagacaagcgcccagaattttcaggttccgccgcatccgctccgtcatcatcgctttcgtcatattgcattgcctccccgcataaggtttagaggattaagggaaaaaggaggggaattcattgaaaataggctttatcggcaccggaaacatgggaacgatcctgattgaatcgtttatcgaatcaaacgctgccgatccctcacatatcaccatcacaaacagaacaatcgaaaaagcattaaaactaaaagaacgtttcagcggcatccacgtcaccgaggatcaggaaaagctcgtacaggataatgaaatcatattcatttgtgtaaaaccgctggatatatatcctttgctgaaaaaactcacaccgcatttacggaaagatcacattttaatctccattaccagccccgttcagacggatcagattgaacatacggttccgtgtcagacggcccgcgtcattccgagcattacgaaccgcgccttggccggcgtctcgcttgttacgttcggcaaaagctgcagcgagtctgcaaaagcggatattcaaacgctgttcactcatatttcaaaacctgtggaaatcagcagcggtattacaagagcggcgtcagacattgtcagctgcgggcccgcttttatgagttatctcgttcagcgctttattgacgcggcagtggaagaaacggacatcaccaaagaagaagccgtgattatgtcgacagaaatgcttgtcggtctcggaaagcttcttgaaacggggcattacacgcttcccgccttgcaggaaaaagtatgcgtaaaaggcggcgtcaccggagaaggactgaaggctctcgaaagcggtgttcaggatatgttcaatcgtgtctttcagcgtacacatgacaaatacgatgaagatatatcgttagtgaagaagcaatttcacgtgtaactgagtatgccataaagagctttatcacgccaatcgcaaaaaatgcattttaaaaaccatcgttccgtttaaacgatggtttttggtttgcctgccgtaaagaaaagacgttcagactctgttgaaggaggccggtctgtaaaatcagccgtcactttcttcaattcaaatccggtctctgcaagcatttgtttatattcttcaatgtaaaatgttttttgctcatgcgtctcgtcatagcggtcataagattgtccgttccatacgaaaaaggacatatcatggatgacagaaagctcttcatcgccggcaaagctttgccagatatagctgatctgctcatcctgatccgcatgggtgctgtccggaaaaagctccgtcattttatacggggaatggacgtcaaacagaagcaggccgccctccttcaaaacttgaaaaacacttttgaaggtgcttaagacatcatttttcgtttttaagtaatttagggaatcacagcagatgactacggcatcaaactgttcttcaaaaccggaaagctctctcatatcctgctggagaaaaagaatcggctttcctgtttttttctgctgggcacagctcagcatatcttcactcaaatcaatccccgtgacttcgcagcctttttcagcaagcctgatggatatttctccggttccgcaggcaagatcaagcacccttcccttttccggaagagacgcttcgatccagcccgcccattcatcatacggcgcatgggacattaactcgtcatatacaccggcgaagccttggtaaatcatgagttcaagccgagttcaagctctgcgagcggcgcgtcgccccatagcttttcaagattatagtagcttctttcatctttatggaaaacgtggacaatgacgtcgccgagatcaactaaaacccagcgggcctcatcaaacccttccatctttttgacatcaatgccgttttcttctgcctgatctttaatttcgcgcgcaatggcctgaacctgtttatcagaattcccgtggcagattaaaaagtaatccgctacaagtgagattccttccatgtccagcgctaaaatatcttctgcacgtttatcgtcgcatgcttttgccgcgatttttaatacggaagcttgattcattttccatattcctcctgtcgtttttgagacaccagccagttataggttgcaaacgtctccggaaagaccggctggttttttttcatcagaaatatcattgtatttttcatcgcttgtatgagcgcttcgttcagatctgtttccgccagacggcgcacctcttccactccgggaaaatggcggccgggttcaatgtaatccgcaacgtagatgactttgtctaaaagggtcattccgggacgccctgacgtgtgatagcggattgcatccaagacctcgggatcagtgatccccgcttctttctcagccaaatacgctcccacaggggcatgccacagctcggcattgtaatccaagagctcagcaggcattttttcccgcacgatgatctgcttcatttcttctttcggccggaatttcgcataatcatgaaaaatagccgccatttccgcttttttcggatctgctccgaaccggcctgcgagaataaccgccgtatctgtcacgccgattgtgtggatgtagcgatgctcggtcagctgttctttgacgcaggcaagtgcttcctcacgattcatataaatcattctcctctatatactgcctcactttatccggcattaagtattgcgtcggcttttttgctttgagacgttctctaagcatcgttgacgaaacgtcaaattccggaacgtcggcaaaaagcagcgggtacggggtctcgatatgataccctgggcgccgcactccgataaattgaatgagcgtgagcagttcgtccagtttgtaccatttcggcagatattcaatcatatccgccccgataataaagaaaagcttgtcgttcgggtgccgctccttcagtaaacggacggtatcataggtataagaagggcctttccggtccatttccgcaagctcaagcttaaagaaggaattagagctgatggcaagcttcagcatctccacccggtgccggctgtctgtaaagtcttcattctgcttatgcggcgggattttattgggcataaaccaaatctcatcgagctccgcctgatgaaggacttcattagccatcagaagatgtccgttgtgcggagggtcaaatgtgcccccgaatattccgattttcttcatgtcaaccaccttacggaagctcgatttgtttattttcctttgattccttatacaatacgatcgtatttccgatcgtctgcaccaattgtgagcggctgcctttcacaagcgcttctgcgacatcgtttttatcgtcttcgcagttttgaagcacgctgactttaatcagctctcttgcttctaaagcctctgcaatctgtttcaccatgttttcgttgactccgccttttcccacttgaaaaataggcgttaaatgatgcgcttttgaacgcaaaaaccgtttttgttttcctgttaacattgtgttcctcctagttttccttcaacaattgctctcattaagccgctgtcaggctcttgttccgtccacagcttgaaagacagtgcagcctgttccacaaacatgccgacaccgtcaagggttgttaaacctcttttttcagcttcttttaagaacgccgtttgaatcgggttgtatacgatatcacaaacgatggcgcccgttttggcccgttccaatgagagcggcacggcatccgttttcggatacatgccgacagatgttgtatgaataatgacgtcatattgttcaagctgattttcagcttcttttaaagtaagggcgcgtttctgctgaaaagagggagcagccgcaatcagactttccgctttttccggcgtgcggttgcaaacgtcaaattgtttcggctctctgcggacgatcgtcgtaaaaatcgctcttgccgcccctcccgccccaatcatgaggatggagagctctgatatcggtttgtccaatactttgactaaggatttataaaacccatctccgtcagtattatacccgatgagcctgtctccctctcttttgacggtatttacggccccgagtactttcgcgctttcatgtatttcatccagatgctccatgatcgcgactttatgcgggactgtgacgttcactccgcagatgccaagcgccttgattccgttaacggcgtccttgagataatgaggttccacctgaaacgcaaaatactgcccgttgatgttcttatcttgcaaagccgcgttatgaatatcgggtgacattgaatgcccgatcggatttccgattactccgtacaattgtttcatgctccctctccccttctctctatattaatgaacggcggacaaatacgtgtacgcctttcggagcgtatgccgttatttttttatctgcttgctgcaccgtgacccagccgagtccggaaaaaacgatatccgtctttccttctttaatcgtaaacgtgtgggccgtaagctccggaaattcatccaaatgatcttttccgggcggggtaagcagttctcccgcatgcttttcgtataaggcatcagcattttcaagctttgttctgtgaatcatcaattcattcggcatatagcagacaaacgccgttttatcgcctgatacatagtcaaaccgggcaagcccgccgaaataaagcgtttgtttttcattcagctgaaaagtgcgcggcttcagttcttttttcggtgtcagcacctttaagtcacgcttgtccacgtaatgcgccatctggtgatggttaatgattcccggcgtatcataaagcgcagatccgtcatcaagcgggatttcaatcgcatcaagcgtcgtgcccggaaattgagaggtggtaataatattctcttcccctgagacctctttaataatccggttgataaatgtggatttgccgacattggtacaccccaccacatacacatcccgcccttcgcggtaatgttcaatggcgtcaatgacttccttcatcccttgtccgcgggaagcgctgattaaaaagacatcaaggggttttaagccgtattctttcgcttcgcgtttcatccattggacgagccgttcccgctttacggatttcggcaggatatcggccttattaccgacaagaatgatcggattaccgccgacaaagcggttcagcccatttatccagcttccgttaaaatcaaaaatatcaacgactttgacaattagagagtcagtatcgccgattgtgtgcaagatatttaaaaagtcatcatccgttaatgaaacatcttgaatttcattgtaatttttcagtctgaagcagcgctgacaaatgacattctccttcgtgagcgatgcctttggcgcgtatccgagaccttgtttatcctcggtctggatcgttactccgcagccgatgcaaacaaccttttccattcctaatcctcccactgaatatggcctttacgtttcaaagaactcaatattctccgttcaatccggcggttaaagcgcgtcatgactccgtcagaggaagcgacaggcacgacgaggatcgtatgatacccgtttctgtttccgccgagaacatcagtaagcagctgatcgccgatgaccacacagtcttcttttttcagctccatgctgctgacagctcttttaaaggcgcgccccatcggttttcttgccttataaataaacggtatgccaagcggctccgagaataatttcactcttcgttcattattattggagacgatcgtgactttaatgccgtgctccttcatttcttcaaaccactcgattaatcgaggtgtcgcactcggtctgtcccactccacaagcgtgttgtcaaggtctgtaataatccctttcacattgcgttccttgagcttttccggtgtgatatgaaatatatttttcacaaattcgtcaggtaaaaaaaacttttttaacaaaacccgcacccttccttttctttctatcatctatatgtcgaaatctgtcagatttaaaaacaaagtcggactcggtaaaaaaatttcgacaaaaattgggtttcttcaccagttgtggataaaattacacacattatccactcttattacatccggatttatccagattataaacaagatactaacaagttatccacttacgagtgtggataacagaacgattgttcttatttgtatttcatggtagattaaagataacctcaccatgattgaaacgcaaccttccatcatatgcttgcgtctgatgattgattacaattgtaaggaggtgccactcccattaattgggtccccggcatgagaaagctttctgatgaattactaatagaatcttatttcaaagccaatgaaatgaatttgagccgtgaatttatcgagttaattgaaaacgaaatcaaaagaagatcgctcggacacattatttccgtttcttcttaaacagaaaaaattcccgggcgaatttcctttttttactcagatgactgatattatatcacttcggttatgcgcattactaccactttcaacaaaaaacacccctaaaatagaggtgtttaagaggacggctgctatatattgaaccaatacagaccgcccagaacgagaatgacgacgagcagcacaacaaaaaatgcgtaccagtaccccgcattcacccgaggaggcgggcatacaggatattgcggagggaaaccgcggttcatagcaatcgcctccaaaagatgttttttctacagcctatgaagcagaagcaaaacggtttaggcagctgacggcgtcagcgttccaaaacccgcccattttttatgccttcaattaagattctggcgccttttggcgtcatatgatttccggagggatctatcagtccggattggatcagcgcccggtctgtatctttgccgccgtccgcgcgtataaagtgtttccagttatccaccagcggcactttcaactcagctgcaacctgcctcgtaacgccgttataggaattatgccatgttctcgcgccgcctttttctttaaaggctgaggctttatatctcgaatagtaatagagatgatgcgttccgtttccttctataaccgggatgcacgtcattaaaatcggctttatgccgtgatttctgctttcgtttatgaaataagtcaggttttctttaaaccgtttctttgatactcgcggctgatctcccgtcaaaatgcccgcatcatttgttccgaacatgataaataaatattggggcttacgctccagcacgtcgctttgaaagcgcaggcgcgcatcctcagtcgtctggccgcctattcccgcatttataaccgtaagacggccgcgttccgctgtttttaaaatgtttacccactgctgcgccttcggataatcacgataatcccagttggaaccgcgcgtattgctgtcgccgaacgcgacaacacttttctctttgcccgcagcgcatcctgataacagacaggttatcgtaataaaaagaacagcaaacttcattttctctccccccaaaccttacctcctatggtacacatctctttggcggctttcaacgcggcgctctctttactggatatgaaaaggaccggaatcctgtccgatcaaatccgaaaccttaacaaacgtgtagccctgctttttcagctggggaatgatttctttcaaagcctcaaccgtctggcgccggtttcctccgccgtcatgcagaagaacgatatctccatctctggcatgtgaaacaacgtgcctgacgatttttccttttccgggccttttccagtccctcggatcttggttccatgaccacatgatgatatgatagccctcttttaagaggcttttgaaagccgtatgattcagcgaccctcccggcgggcggaataacttgtccccttccggctgcagcgatctgatatgatgcgcggagctgtgaagctcttgtaaaatgtctttgcgttttaaacggtgaaaataaacatggttcatcgtatggttgccgatttcatgcccttcttcaacgatgcgttttgccgttacggggtatttgtctatacggctcccgatacaaaaaaaggttgctttaacattgtgctgtttcagcacgtctaacacagcctccgtatagacaggatgggggccgtcatcgaaggttaaagatagcttctttttttcagaccttatatcccagtacacgtttcccgtcttctccatgtcacttctttttaaagatttcgcatcggcggacacggcagtgagacccgtgaggacgcatatcatgatgatcagatgaaagcatctcaacgtttacacctccagtaaacactactgttaacgtgtccccttttgtataaaatcattctctgcatcaaatgatgcacatcacccgcttcccgcatgtttttgtccaaacccggctgccagccgtttctcatcaaacggcaaatgctgataaacaagtacgcttatcggacagcttattttaatagaaggagatagatttgtgctgtatactaattgaaaagaggtgaacgtacagatgataaaaaagggattcagtcttgccgtcatcattgctgtcgtgatgatcggctttatgcaaaaagacgtctggctcagcatgattcgcgcgggcggcatgtatgccgtgcttatgagtatccttctggtcgcagctgacgtattttttccgatcgttccattcgccattatcgcggccttaaacggagcggttttcgggattgtaaacggagtgtggattacattgtcaggcgcaatgctcggaacaatggcattgttttttctcgtccggtacggattcagagactgggccagaaaaaaactggtggcttacccggccgcggctcaatatgaaggttcatttcatcagcacgcgtttacggcggtgcttttcgggcggctgattccgattataccgtcgcttgccatgaataccgtctgcgggctgagtaacatacgatggccgatctttttttctgcgtcggtgctcggcaaaattccgaacattgtgatcgtgaccgtcgcaggcgcttcatttacaagcaacaaactgctgtctttcgggatttacggaatgtatatgctcgtcttaatggcggtcatttataagaagtttcccggtcttttaaaaacaacgaaaaaatgaagcgcgtaccgcctcctattccggcggtacggctcctctcattctgagaacttttccgtttaattctaaattgatgcagcttcgttccgcgttctctttgctgctcagtaaaggtgcacataaccgattttttggctgcggtaaaagttgatggaagcttcaagctgtccgatcggctgcccgttatgaagaagcagcttaaaattgtcgggtgagcattagatttgggatgacagccacctgagatactcatcctcacgaaatgaaacggccgtctctttatgtttctttaaattgatccgcttgaaacacatcgggagtcctcctttttgaggccgcaaataagaacgagcataaaacggctgccaacgccagcataacagcagcccctgcgatgacgatgacgcggacggaagaaccgacagccgccgctccgaaaaccgccgttaccaatataatgaagacggcttcgactaatgaataaaagctccccactctccccatgatgtccaccggaacattcttttgataaaacgtcagaaagcctgtattggcaaacgccagaaaaaaagcgagaaggaaaaatccgaaagcagccgtccaaaaaacgtcagaaaacgcataaatcatatatccggccgctgtgaataaagagcccattcccatcaataaagaagccggcatttttttattaaagattacattgacaagcgcccccgcaataatgcctgcccctgagacactgacaagaaaaccgtaatcggcatcagtcagctgaagaacttcttttgaaaaagcggcttcaagcgaatcaagcgcggatggcataacggtcatgaccagactgaataaaaaataaatgatcatgacgtttcgcgccgttcggctgaagcgatagacgagcttccaatcttctttgcacactgccaaagaaagcttctgtctgggagaatgtacgtgaggctcattttcaaggctcggcagcatcatcgtgatgaaaccggacagcactaaagccgccgcattcacccaaatcgcaaaaatcggcgtgccggcgataaaaagcagcccggccgcagccggcccgaggagaaaagcccctgattccgacaaagcccttagtgaattgaatcgttttctcctttcagccggaataagcatcgtcacatacgccatggaacacggacgaaacatcgcattggccatttgaatcaaaaacacgatacaataaatggaaaacaaagaccttacagtaaacatcagcggcagaacggcaatgaatgcagcccggatgaaatcaagcgacatcatcatattccgtttgttacacctgtcgatgatgctgcccgcccacccatttgtcatcaaaacagccgcaggcctgattaaataaaggatggaaaccgcaaaagcagaccccgtttcttttaaaacaataagattaagagacaaaaaataaatccattcaccaatatttgctatcccgattccggttaacagaagcatcgggtaccgccaagacttcaggtttttcatcttatccctcccttagaaataaaaaacgccctcaagacaataaagtcttgaggacgggaaacagcccgctatgccacctcaattcggtttggtgccggcctcttgccgggtacaaaacttactcggtaacaggagtatccgccgcatcatcctcgtttttcatgattccgatgcgaagctaagaggtttgtttcaacacatccattcatactccttcacagctcccggagctctctgtcatgaatgatatctgtctactcgtctcttcagcgcttttcgttatattcttttcacccttactttttttaacaatatacaggctcaatcagcaaaaatcaagaggctgtaagaaataaaacctgcctttgattaatttccctgtacagacacaaacagcctgactgccacatacagttacatataggcttttgcctacataactttgtggaggtgaggatggtgacaggtgtttttgcagcgctcgggtttattgtgaaagaactcgtgtttttagtatcatacgtgaaaaataatgcctttccacaaccgctctcaaatagtgaggagaaaaaatacttagaccttatggctgaaggcgatgaacatgcccgcaacatgctgatcgaacacaatctccgtttagtcgcccatattgtgaaaaaattcgaaaatacgggagaggacgcagaagatctgatctccatcggtacaatcgggctgatcaaaggaattgaaagctactcagccggaaaaggcacgaagcttgccacatatgccgcacgatgtattgaaaatgagattttaatgcatctgcgcgcattgaaaaaaacgaaaaaagacgtctcccttcatgatccgatcggccaggataaagaagggaatgaaataagcctgatcgatgtcctcaagtcggaaagcgaggatgtgatcgacaccattcagctcaacatggaacttgaaaaggtcaaaaaatatatcgatattttagacgaccgcgaaaaagaagtcatcgtcggccgcttcgggcttgatctaaaaaaagaaaaaacgcagcgcgagatcgcaaaggagctcggcatttcaaggagttacgtgtcgcggattgaaaaacgcgcattgatgaagatgtttcatgagttttaccgggcggaaaaggagaagcggaagaagaaaggaaagtgagcgaaaagccggatctgacatcccggctttttctgcattttaggacattcctcttcaagtataacttcaggatttaaaagtaaaacataacaaatgaatagaattggtacaatcgttaacctttttaatgattttgaacctcataggaacccttacatgacaggatttttgttgtttttcattgtttatcaagatctaaagcaaaagaacttgctatttctcaaatacatccaccaaattttcaatgttagtttgcttttcatacatactactaataaaagtaaaaccttattagaactttacaagacaagctgaattgactatagtctaattagactaaaatattgatgtaaagaagtgaaaaattaaatgataaagtcttttttaatgttggggcagtcgaatatggcgggccgtggatttttgaatgaagtagaccctatctataatgaaaaaataaaaatgctgcgcaatggacagtggcagatgatgacagagccgattaattacgaccgtccggtttccggcgttggcttggcggcatcttttgcagatgcttggtcgaaagctcatcccgatgaagaaattggcttgatcccttgtgcggaaggcggcagttcattgaatgactggcatccggaaggcatcctttttcagcatgctttgtccgaagcccgcttcgccctccgttccagtcaaatttgcggaatcctttggcaccaaggtgagagtgacagttatcgttcgctgcatgaaacttattacgagaaattaactcttatcattgagacgctaagaaacgagttgaaacttgatgatgtaccgttgattattggagggcttggtgactttcttgggaagaccggttttggacagcacgcgactgaatttcgacaggttaatgaacaattgctgcgttttgctaatgaacaacagaattgttattttgttactgctgcaggtttgactgcgaatcctgatggcattcatttagacgcagcttcacaacgcaaattcggttaccgctatttcgaggctttctcgaaaaagcaccatatcctgaaacccatttcgggagaggagcaatcactgaaagtgaagggtgactattctaaaacagaacagatttaccttcatagtatggatttggcttcgggtaaaatcacgtacgcggaatttgaggcgcggatggagaaggtgatgaaaccatgattcccttacttatccttggcttgctcatccaaaaccccggagctcacggctatgaacttctggccttaatggaaaaacgtcattacaaatacattgttaacttcacgaaaggttcattttattacaatctgcagcaacttgaagaaaagtgtttgattgaacagattcagcagaaaccctcaaccagcgggcgtgaaatccgtaactttaaagtcacagattcgggaagggcagaatttgaaaaattaatgatcaaatacggcaccaaatcggaatatgtgaacctgcaattttatggggcgttactctttgccgatgaattcgacaaaaataaattactggaactgatccaatcacaaatcgatcagactaaaactcgaatcgagctccttgatgaatacctgtccatcactcaagaaattcccggcacaatcaattactttcgccgtatgaatgaaaattcccgttcacatcacttggttaatttagagtggttcgaaaaattgaaagcagaaatagagtgaactattgcataataaaaaaatgcaatgtggaatatataagaatattttagctaaatataaaacctgtgtcgcagatatctagtaacatcattgatacaggttttataccccttctttaattaaaccagctaatagggttgtcaacacttgccccaaacaagagcaagtgagtctgctgcgtgttcttctttttcaatccgtatgaataaccactttttacacctattcagtattcaagtaagtcaactgatttttctccttcttccgctaaactgctgctttagtcgaataaaaaaagtgatctcccttaaggaagaatcacttcctctaattgaacaagcagtgaagatgaacatcgttctcgacatcaactaaaattttttaactgcctccgcgtatgcagctttcaattgattgatagtaaacccctcccgcaagaaaactccgtctttttctattttcttttcaatataaaacaatgataactttctttcatcttatgaaacccaagcagttattaggtgttttctttatctgtacaaatacaggtgagtaacttaatttattacatataagttatcctgcaaaactgtgcacgaaatgtcgggcagatacatttcgctcctgttattcttttgttaaaggaggtcaaataaatggattcgcttaaaaggatgaacagcgcattaacgtatattgaagaaaacctcacgaacgctattgatttcaaagaagcagcaaggcttgctttctgctctgaatatcattttaaaaggatgttttccttccttacaggtatttcattatcggaatatattcgccgcagacgtcttactcttgcagcttttgaacttaaagacagccgcgtaaaggtgattgatcttgcaataaaatacggttatcactcaccagattcttttgcacgagcatttcaaaatctgcatggcataaacccatcagaagttaaacataatggccattcacttaaagcttatccgcgaatgaccttccagttatcaatcaaaggaggaaatgaaatgaactatcgcattgaagaaaaagaggcatttcgcatcgtcggcattaaaaaaagagtccctattttgttcaaaggcgtgaatcctgacattgcatcgatgtgggaaagtttagatgaagcagcaatcaaacaactaaaagagctttctaatacagcgcctgcaggactcatcagtgcatccacgaacttttctgaaggcaggacagaggaaaacggagagcttgatcactatattggcgcagccacaacgaaacattgcccaaatcacctatcacagcttgaagtccctgcctcaacatgggctgtattcgaagcagccggatcatttccggatgcactgcaggaagtatgggggcggatttattccgaatggtttccatcgtcacattatgaacaaattgaaggcccagaaatcctgtggaacgagcataaggatgtaacatcgccatcttttaaaagtgaaatttggatacccatttcaaaaaaggaatatatctgacaatgaaattagaggaattaaaggttttaaggaaggggtcttatcccttcctctttatgtcactaaccccatctgcggcaatattgatgccgctaatcttcgaattgagttttttaatgagcagagccgatcttactgaaaatataaattgaggtgtattgcgttttgatgatctgcttctcacttcttattttccgccttaacatccgatcatttctgcaattcttctgcaaagtctgacgttgatgattgaccgccaagtctcccgttttgattcctgccttcacggtttcccgaagtgagttctctattaattccgctgcttctttccgagaataaatcacttcacaacagacaaactgaaggcggtataaaaaacagctccgttaaaatggccggaactgtctttgacttttggattttgcagttatctccatccgttagtttaattagaattcagataatccaagacacgatcaactctttcattgactgagtaatctccttcaatttttaacaatggacaagataaatccgacatccaatgttcgtgtaaagctttgcttctaacttccattccggaatgatcatataaagaagcccactctaaaaatgtttttgattgttcatatttactgccgccggctaacacttcgtttccataacgctgaaattccctatgccttaatctctcaagccgtatatcctgcggaatccataagaagatgacaaggtcaaaataactttttagatcatcgccccagcggcacactgcgccagaaagaatccatttctcatttattgtcaagtcttttttaagtaactttcttctttcagcgatttctctttttttagtgaatttatctgtccaatagtaatcatcagtatcaagatgcgtatgcggcaaatgctttgataatgcaacacccaatgttgacgttccgacaccagaggctcccaatatgtgaatcttatttttcatacttccccctccttatgaagcaaccaaactccctgttgcataaggtacttactattattttgacataaatccctaaagacctttactttgccaggggaatccagatgcggttaaaaccataccgcttacgaacttcatagtcattttcaaacagtgattaactttctctccggcctattttaatatcctcatacactttttcaaaagtctcgattggcagtgaaaacttggttgttttctcgttacggtaattgattacgattatttttttgttcagactcaataagtgcattctcccatttatctctgattgaaatgatacaattttccatttttcttttcctttttcttataaatgtaattcactttaacgcccctttcattgatcggcaaaaggttccgtaataaggaagctccttaaaaaaaggatcaaaacttttatcaagtttgatccttttccctttttagtcatttcttcgcgaacgtttatagacattcatggttaccagccagctcataacaacgattcctgtaaaaagaatgagcatattactgtacaaataagcggaatgatcatcgttaacaggcagcagcctttgattcagcaagctgatcgataataaaccgcctgcaatcgaaatacccgttccctctgataaaaagctcgtaaaattaagcagactcattccggcgccggcttccttttgtttcaaactgccagacacaattgtagatataaccgtttttgtgaaggagagccccccaaacacaaaaacgattatgacggtcataagccaaggtgccgcatctatgaaaaaggcagcgattaaaaagctggaagacatcaatacaatcccaatggtcagcacacacaaagaacctttccgatcaacaagcaatcctccaatgtaaccgaagatgatgacgctcatcgtcccggggaacataatcccgcttccaattgccgcagtacttaaatggtgaacatctttcatcatataaggaaccatagacacaaatcctgcagcagtgccgaatatcaggcctccgctaaggacgcccgtcataaacaaaacatttttccccagtgcagggtcaacaaagggatcttgagttttcctaatatgtttcacaaatatcaggaaagccagaatactgatgatcagaaaagacattctatatgacgttgtaaacagcagaaaaaatacggtgcctgcagacattaatataatccccgtcatatcaaagcgcccgctgattctttcttccttttccagcagtttcatcaggaatggaacggtgataactgttgctgtcggaataagcagcaaatatgaccagtgaatataatgagcgatcattccgccgatagctggtccgacaccttcccccattgccaccagcgacccgatcagaccaaatgctttacccctgttttctttcggaatatagcgtactactgcaaccatcacaagagccgggaatgcggctgcaccagccccttgaataaatcgggccagaatgagtacaggaaagaaagagtgtccgacaaatccaatgatcgatccgaagccatttaccataattccaaataggagcagttttttgatgcccagctgatctgataacttcccatacagagcagttccgatggaaaatgttaacataaaagccgtgttcacccagtttgcactcgctggcagtttatgaaaatcgttggcgatatcaggtaacgagacgttcaaaaccatttcatttaatacgctgaaaaatgacaaaacacaaagccaaatgaacacttggttgtgccgtaaagctgactgtgaataaggcgtattcacaaatttccctccattaatgagggcagacgcagtttatagggccattgatacgcttccctcttttaattgtaccctgttcatttttttgcacttcatacataactccccctgcattgattgatataccttattataaatcctcaagccgatgttttgaatactttgcggcacacacccgctaaatgacgaaacatcaaatactgttatatttaaaatttacagtaccaaaaaaccgcaatttcatttgctgttgaaaaattggaataaagcattgtatcgaccgctcctatgacaaagttatttttggcataaaaatgacaagctgaaacattaatatcttgtgtttcaagcataagaccgcataaatgattctcctttgcccactcaatcgctttatgtaataaagccgtcccgacaccattttttctataatcttttgcaacggcaatgtcttcaatcagtgcgtatccattccaattagaacgaagcttactccggccgacacagtcgttctctgcgtaataaaaaaagacaactttatcctcttcttcagcataactgacatcaatgtcttcatcgtcatattttttgacataaggttcagcaaatttctcctctgtatatgtccaaacattgttttcaaatgaagggatgattctccctgaaacaacgaaaggttcgtttggtttattgaagtctttcatattgaattgagtcattttagttatcatcataatcgcctttctgcagttattgaactcactttacaccttttgaactgttgattcgtctgcatgtcacgaagactaatacaaaaaagataccaacattgattggtatcatctattcgttcgagcccttacaacaacatcctatttcggagcttccaaaccaaatgttgtccattcctcttttgccggaccataaatacccggaacaggtaaacctgcttgtctcataaggacagtcatttgtcctcgatgatggttttgatgttgaattaaaaacatcaaaagtgaaccattcggcaattgctgaccaataaagttgacacattcttgaagtgtatcgtcagtccattgcgtttttaacgcctgcacaaatgcattactggcttgatgataactctcagcaataaaccgcgccgatgcaggaacaggataatcttcagccggagcgtggaacgttaaatctgtgttcgaggtaatgatatgaatggccgcgacagtatgccatgcaatacggcctaaagtccaatgttgtgaagtgatttcttgtttaagtgattcatcagtcagatgattcagcagtttttgtgtcgcatcggcttcgaattcccaagatttcaaaaaatggtctaaggtttgaaacataaaaatcctccttatccttttttgtgtttctatatatctgcagttcaattatagcgctccgtttagttaaaaaagaacaaaacgatacacagacaatacaataacagacaaaatataagaacataacagatcactctatacttccttttcttcaatcggcaaaaaaggatagctgttcaaacaggattcttctgtgtctaatattttcgctttacaaaagtccataccgtcttagtgattgaaccggagataaaacagctccccgtcatcatagccacccaaatgaaaaatgtcggttcggcacctattacaataaacataaatatcaaggacaaaatgaatacaataacaaccatcatccatacttttttgaagatgaaatatcctaaaatccctaacagaaaagaagctgctggaagaaaaatgagaatgatatacgcgggactcaacagcgggctaatacaaacacctcccaatttcaaaacgaggaagttcctactttttgtctgatatcaaatgatatgaagtgatttatttcatcttgatattacgccgtttcattcattttatacatattataccaatacaattgggtcaaatatagatatttattcatttttaacatattttcggaaaatcaggagtgatttaaagtcggaggatagcccgctttttcttttcctagtaagtcctgccgcattggctttagcccatctgctttctcattgtttttgcagcgctaatattctcataatcgtgtgcatgacgctgctttcgtcatttgatttgatgacaaagtgcgccgcatcttttatttcgtcaatggcgttcttaaccgcaaagctgtaggaagccgcttccatcaattctttgtcattgcggccgtctccgaatgccattgtttcatcagccgaaacccctaataatcgctgcagttcttgtactgttgatcctttatgtattccgatatttgatatgtccatccaggtatcttctgatgctacgatatataattggtgaaaaaattcatgcagcttttctctcgtttccggacagttggcgtcggggtcatgaaccgtaatcttgataaaatcgtcttttatctcagtaaaatcagttattttcgttacatgtgcataagaggcatttacatatttcatttcactttcagacagattttcttttacgatcgcgcctttttttgtgcacgcgataatggtgtgcccgcagctgattttttctaaagcgcctataattgacagtccggctttattgctgatcaaagattcatatacgaatttgccgttctttttcatacgtgcggcactgtctcctaaaatccaaaaatctttcgcgtcttctccgaataaggcttccaccctttcacactgtttcccggtgcagatggcgaaagcgacatgctgttcttccattactcgttttgtcttttcaaataacgttctgtcaaaatcgccttgattatttaaaaatgtgccgtctaaatccgtaatcactaatttaatcatcgttcagcacctccgcagttaaaatgtctttttcagacaaagggtttttcacatttgagaatggaatcaatcgcgtttaagaccccttcctcattgtttgattgcgcgatatgcgccgcggcctgtttaatgctttcctgcgcattatccatagcgactccgtatttcacggcagacaccatctccaaatcattgccgctgtctccgaaggccgcacattcttcatcatttatcccccattgtttctggagaagcctaatcccgcttgctttatgaagccccggtatgatcagatctatgtcaccgtgcccgcttgatacaggcgtgacgaaagacccgatggcgtcttttaaatgcctcagaagtgcggaacaatgttcggcgggaaaactgatggaaaattttaaaatgtcatcatcgatgttttcaaaatgcggcaccctttttaacacataataatacttactggcatgcagatattcatcctcactggcattttcatgaatatacgcgcttttttttccgcagacaatgacgtttttcacctcatactgctctaaagcacggatcacctcttttatagtgtcttcagacatgttacccgcgaataattcttctccggcattcacgacgaaagcgccattctcggcaacgaaagcgatttcacttttgatttccggaaagaaggatgtaagctgcgcatattggtttccgcttgctacggcaaatttaattccccgcgcttttaattcacgatactgattcataaaacgctctttgttatatgccatttcatcattcaaaaacgttccgtccatatcaaccgctatcagtttgatactcatattgtcctccttttttcgaccgcttttgtcagagacccttgaagagatcatgcataagcgtatgaacgaattatatccgcagttgttttgcaccgtaaatcattggctgacgtcttgttttgaatgacacaaaaagtgatttgtcacataaatataacactatgtttcttttaaaaatgatatgttacgatgagatgtacattcaccattctcataaaaaggagaatccccctgcatgttcacacacgaaatgattgcttcatttaacgagcttgaaacttctttatacaactacatctcccaaaacagcgagaaagtcgtctatatgcgaatccgtgaattggcaaatgaaacccatgtatcgacggcttctattttacgtttctgcaaaaaaataaactgtgaagggttttcggagtttaaggtgaagctgaaaatgtatgcggaggcaaataaaaaaacgattttaaagagtccccatcattccgttgccgagttttttgaaagaacagtaagcggagggatggaagaaaagctgaaggaagcagcagcccttgcagccgatgcagaaagcgtcatttttatcggagtgggtagttcaggaattctcgccgaatacggagccagatatttttcgtgcttagggaaactttcaatgtatattaaagatccttactttccggcccattcccatttccgccataacagcatcacgatcgcattatcggtttcaggtgaaggagattctacggtgactcatctgaatcagctgaaacaagaaggaagccgggtcatcagtattacaaatcataaacattcaaccattgccaaaatgtctgatgtgaatatttcatattacgtgacggaagaatgggttgaaaatgcgaatatcaccacccaaatccccgctatgtacatacttgaatcaatggctcgggagatatacaaattgagagattaaattcaggaacggaccacggaaatttcggcctttttgtaaaagtgatgaaaaacccttctctgctgccagagaagggttttgaagattacagatgagacacaatacactttgcatggcccgccagtttatattctcccaaaccggaaggcaggagaatgtgatctccttttctaaagggatgttcatgcccgcctgcaattattattccgtctccttcgatcacgctgacaagaaggaagggatgattctggaataaattcgcttcaccttttacatcccacttttcgactgaaaaataaggacattctattaaaacagctgccagcagatcatctgtttgtttatattgaacggtcggccgttcacggacagatggaacgtctgtcacttctatacttttttccaaatggagctcgcgcagcctgccgtccgcatcttttcttccgtaatcatacaatctgtaagtcgtatctgaattttgctgcgtctctaaaataagtgtgccctttccaatcgcgtgaacggtgccgcttgggacaaagaagaaatctcccggctttaccttaactctgttcagaagtccgtcccattctccgcgctcaatcatggatatcagttcttcttttgttgttgcgctgtggccgaaaatgatctccgcatctttttcacaatcaatgatataccagcattcggtttttccaagttccccgttttcatgcattttggcaaagtcatcatccggatgcacctgaacggacagatcttggtccgcatccaaaatttttgtaagaagaggaaaacggtctccttcaaggtttccgaataaatctctgtgatgctcccacaattcaccgagcgtacatcctttatacatgccgtttcgaactgtgctctgtccattttgatgagcggcaaaggcccagcactcccctgtccgctcggacggaatattatagtggaaatcacgcagggcggcgcctccccaaattctttctttgaaaaccggattgaaaaatatcggttcagtagacatgatcatcccccgctttattcgatttcttccagaagcccatacgcctcttcttttgtctgaacggagagcagcctttcccgatagctgtcatccatcagttttcgggataacatctgcaatattttcagatgctgatttccgccgctttccttcggtacggcaatcataaaaatcagttttgcatcagaaccatcaaggctgttccagtcaacacccgaacgtcttattccgaatgcgacacccggcgttctgacggcatcagactttccgtgcggaatggcgatattcatacctatcgccgtggttccctgctgttcacggctcaaaatggcctgtttaaatccgctgtcagacagaagcatacctttacgggacaatttctcgatcatttcatcgataatgtcatccctcgtttcgccggataaatgcggttcaatcaagtccgtgctgataatgtcagtcagttttttgatttcggtcatcccggcttttcggctgtcagcctgagatggttcctttgtttcttttgccgctgcagcttcatttggtgcggcagacggcagcacctcaccgggcgcgggggatttcgccatatctttcttcagtacattaaccaacagagcggtgacaagagagcctgctgttacagcgataaaaaacatcaatacatgatctactgctccaagtacagcaacgatggggccgccgtgtgccactctgtcccccacatggccgatcatcgctatcaccgagccggtcatagaacccgccataatactcgggatcacacgaaggggatcttgggccgcaaatggaatggctccttccgtgataccgaaaaggcccatcgtaaatgacgcttttcccatttctttttctgcggcggcgaattttctttttcctaaaaacgtcgcaatcccaagccctatcggcggtatacaaatggaaacggcaatcgggcccataatttcataatttccttctccgatcattgccgatccgaatagaaaggccaccttgtttacgggtcctcccatatcaaaggagatcatcgctcctaaaatcaatgccaggagaattgagctcgagcctttcattcccgcaagccaaaccgttaatgatgcgaaaatatgagcgacgggggcgccgatcagaaatacaaacgccaaaccgacgatcagtgaggcaaacaccggaataataatgatcggcataatcggctgtattgctttaggaactttacattttttgattccaagcgccgcatatcccgccaaaaatcccgcaatgattcctccaagaaatcctgcgccgctcgcactgtcgtaaaagctgccggatgccgcaatatatccgccgatcattccggggacaagacccggcttatcggcgatgctgaacgcgatgtacccggctaaaatcgggatcatgaatgaaaaagaagcgctgccgatctgttcaatcgttttccaaaaagacgcatccggaatgactaagccctttggtgttttttctcctccaagcgtcaatgcaaccgctatcaataatccgccgacgacaatgaaaggaaccataaaagaaacgccgttcattaaatgacggtaaatcgggttttgttttttgccctgctgacttgcggattcagtttttgaagcagattgatagaccggcacttcaccgctaagcgctctttgaattaattcttccggtttgcggatgccttcctgaaccccgacggccagcagcttttttcccgcgaatcggtctttgttcaccgaacggtccgccgcgataatgattgcgtctgcttcccggatttcctcttcggtcagcctattttccaccccgattccgccctgggtttccactttgatctcaacgcctaatctgccggctgctttttgtaaattttcagcagccatatacgtatgggcaatgccgttcggacatgatgtaatcgctaacagtttcatataaatcctcctttgcagtctgaatttcaagatcttgtctcaactttatactgaaatcagcctgtgataagcgcgtttttttaccataagttccggaaataacggcatttttccctataaacagaaaaaaagcagggagccatcccctgcttttaatagtttaaatacgataaaaacgtcatcacatttttttcttccgtcagtttttgaataaatgccggctgctcgctaagataggaaagctcactgaataattgctttaccttgttttgatcttcgtgtttgacggcaagcataaatacaagcgacaccttttccgtcccccactcaatgggctcttttaaggtggcgattgcaatggctgattgtttgatatatttagagttcgcgtgagggatggcaatacccgccccgatatttgtcgccgacattttttctctcattactgcatgaatgccatactctttttctacatagcctttttcatacaaagcctgcgccagcttttcaatgacctgataacggtgctctgtctcttgctgtaaaaaaacgagaaacggagtcgtatcattcagcattttaaacgttttttgctcccggcggtgtgatgtatcaagctgttgcataaatgcgctgagcttcttttcatcagcaggctccaaaagcggtgatacgacgatatgagggatcgttacatttccaagccctatcgtagaaatgacgaaatctatatctttatgctttttgatatactctgtcagttccgcttttgcgatacagtcttttatcgtaatgtgatgaaatttgcgttcaattttagtccgcagcaattgcgacatgccaatgcccatatggcagacgatgatcgtccttttagggttatgactgcttcggcgcagccgttcgatcgctgcctgaaaatgcagggtcaaataggccgcctcttcttcaggaatataaagatcaaatgtttgattgatgtcttctaaaacgtcaatgataagatgaaacaaataaggatacatttttttgatgtcgtggagcatggggtttgaaacagagagatcatagctcagccgcttcaacaccggatcgagatgaatgttcaatccattgatcaattcctggtctttatggaaatccagcattttcagttctgaaacgcgattgatcaaatgcctgacgactttggaaagctcagaatcttcaagatcaagcttcttttcttgctgcaatggatagcgcactttcccgcctattatatgtaaagttaaatagacggcttcttcctcgggaaaccggatggcaaataccggctcaagccgttttaaacaagccagtgtccattcatattctttcttcttttttaccgcctccagctgccttgcagagatggcgaccggctgtttcattttgatacggcggatggtcagcaatgtatgcagcagcaaactttcaaatgtttcatccgtaaaatagatagaatggtttttttgtaataacttgatttcttttctcacaaagtccgcttcatgacttaaaaacttactttttataaattggcttgtaaactccgcattatcaatcaaatctgaaattcgcgccaatgcttttcttttgtttttttcgtccccttcaatctttaagccgagccgctgtttagaaaccagtgtgagatcaaatcgcttcagccactcttcaaccgcactgatatcctttttaatggaagctctgtttacaaaatgctgtgcggcaatttcttttgcggaaacgggctttgaattcattaataaatcataagcgatgtgaagtattctttcttcatcggtcttgtgcctgcatgtaaagtgctcattataaatgtgccggcttaaccgtgatctttcctgttcagatatatgtaaatagacgcctaatcccggtttacggatcagctgagcttgagcatgttcattcaggaaatcttcaatcgttttcaaatcattcctgatcgttttttcagaacagcggaccctgtctgcgaaatcttgcacaactaagtagtcatcaggttcagataacaacagatacaaaatctttttctgtcttgaattcatgtatttcatctgtttttctatccttcctgtccgtttctgctggagcaattgtgataggttaaatataccgcgcatacgaaaccgttttcattgtatagtgaaacaaaagagtaaaaagttttgttttttaccgcagattccggaaaaatcatgttttatactgaggctgttcacctttggttgacaacaaaacaccaaccgtttttaaacgattggtgtcggcagcgaaaacctgctgttacagccaaaatgtttcgccaagcgctaatgctctcaggttttcaggaggtaatgcaagccggtcccactcaccgtgcagtctgcttaatgcttccgggcctgtatcatcagcaagccggaatgccccgtaatgcatgggaatgaagctgtcagccttcagctctaaaaaagctttcacggcgtcttccggattgatatgtgacactttcataaaccattcgggttcgtatgctccgatcggcatcagggccgccttaatacgaaacctctctccgatttctttaaagccttcaaaatagcctgtatctcctgcaaaatagatggactcgccgttttcgctttctatgacccagcctccccaatgagaagtatcggtatcccaaagcgttctccgggtccagtgctgggccggaacaaatgatatattcaccccccgcatctcaaaacgaccccaccaattcatttcatgaacctttttgcggcctttttgatgaacagctttttcaatcccgcaggcacgtaaaaatccgggtttcctctcagtttttttatactcggaaaatcaagatggtcataatgcccatgtgagatgagcacggcatcaatgtcaggcagttcgctcaattcatatcccggctctgtcagccgtttttgaaaacccatcctccgcgcccatacagggtcggtcattatgttaagcccctgtatttggatcagaaatgaagaatggccgatccatgttatggcggtttccgtccgattgacggcaacatcacggacatcccttgtgaccgctttcggaatattctcgcttaaatctttacttttttctcttcgttctttcatccatttccacatgtccatgaatccatgttcattcttcacgccattcaagttttcatatctttttttcattatcattctcccttgaaacgtgtattccattagatccaccggacatttatacaatgtctgtaaataccgccccgcttgcttcggctaaatcatgaggcgctacttttagctgcattccgattttccccgcactgacaatcataaacgccagtgtttcagcggatctatcaataaaagtaggaaacctttttttcattccgatcggagagcagccgccgcgtatatagccggtcactcccaaaaggtccttcatggcaatcatttctattttcttctcacctgccgccttcgcagcctttttcagattcagttcttttgcaacgggaacgacaaagacgtaataacgatcagttcctgcagatgccactaaggttttataaacatattcggcagagtatccgattttttgtgaaacggaaagaccgtctgcgggctgtcccccttctgttttgtaacctaatagctcatagggaatgttttgctgctcaatgatacggacagcatttgttttcactgtttttttcgccatggttatcctccgttttctgtatttctttctgctttattttcaacttcgattttaataaaatgaccgctcagttgcgtgctttgtaataatcaagtgcaaactgtttaaaacgctcagcagcgggagagagagcatggttttttaactgggctaacgctatggtgcgttcgcattggtaatctgcaaccgggagaaaaacgaccggaaagtatgaatgctccgcggttttcggcagcactgcagccccaagacccgcggcggtcagccctaatatggttgacacttcctctccttcaaatgcgagatgcgggtgtatattcaaatcccggcacatcagatcaaacatatatctcagcccgtatcccggtttaaatccgacaaaatcctcgtcctgcatctctttcatttgaatgcttttattttctgcaagcgggtggttctcaggaagcaccgcataaagaggctctttctccagcactgtccattgtaaaagctcgctgggaagcggcggggagctgagacagatatccgcatctcccgtttccaccattttgcgaagcgtttcatttgcgccttgatacagccggaaggtcacgtttgggtatagctttttaaattcggcaatcagctgaggcatcaagcgcaacccgagcgtatgaagaaaagatacagatatttcgccgtgctccaggctcatattttttttcacttgttcaacgccttcatttaaagctcgtctcgcttgttttgcttttattaagaactgctctccgtgccttgtcagccggacggcttttgtctctctgtaaaataacggcgcgcctaattcttcttcgagcctgataatcgatcggcttaatgccggctgagaaatcattctttcttttgccgcatttgtgaaatgctgatgagttgccgccgcaatgaagttgtcaatttgatgaagctccattttctccttctcccctttcttcataacctacacgcattaattctatagttattataaattagacacattgaaatgaaaagcgtacgatacatatataaccaacagtgagaaaagagggacattcatgacgtttattcagcctcatacaaaggcttacagaaaggccagcttggcactgtttatcagcggctttgtgacatttgccacgctttacacgacacagccgcttatgcctttgttttcggaagagtttcatatttccgctgcggctgccagcttaactttatccatctcaacagccgttttggcattttcattattggccgctgcttcgttgtctgacggattcggcagaaaaaaattaatggtgctgtcgttaacagccacttctgttttaggtctattaacagcgttcagtccggcttttccggcgcttttggcgatgagggggctgctcggtatttttctggcaggcgttcctgctgtcgctatgacatatgtaggcgaggagtttgatccgaagggcctcgggaaaatgatgggcctgtatatcagcggcacaagcatcgggggaatgagcggcaggctgttaacggggcttctgactgatgtattcggctggcggccggcgcttgccattatcggcattctttctattatattaagctatttgttttggcgttttcttccggctccgcgccattcatctcagcggcatgcgggcgtaaaagcggcatgtaaggaatacggagcggttctacaccgcaaacggctgcttttgttaatatctctgggatttatattaatggggagttttgtgacattatataattatatcggctttcatttaatggcggctccttatcatttgtcacagactgtaatcggttttatttttattgtctatctcgcgggaacgttcagctctgtctatatggggaaaaaagcagatcttttcggaagtgcaaaaatgattaagattgcgatttttgttatgcttgccggcgcagcggtgacacttttgccccagcttgcccttaaaattgcgggcattgccgtgtttaccttcggctttttcggcgcacattcaattgcaagcgcctgggtcggccgagcagccggtgatcagcgcgcgcaagcttcttcattatatctgcttgcatactatatcgggtcaagcgcggccgggtcttgcggcggtttcttttggacgcattttcattggatcggtatcatttcatttatttcggttttgctattgctgtcttatccggttttatttctggcggaattcagaaaaaagggacatagccgcctgcatgtaaatcaataaaaacattaaagatttgtgtcttttgtccgatactaaagataaggccggcacgatactccctataactattccttttgattcagtagatttcaaatatcgtgccggctttcttcaattaaaacacaatcttcaattgccttacgcttctgttacacacctgcccaaacatctttcgcatatcttccttccgcctgcagctgttcaagccaattcgaggaaacttttgaatcagtgttatgcaccttttcatacgcctgaagcagtacattttcgacagccggagccattttgcttccgtctccgcatatatagagatggccgccttggtcaagaagcgcaataatctgtgcagcctcgcgaagcaggacatcctgtacgtaaactttacagtcctgatctaatctggaatacgcccgatgcacggtgacaaggccgtttttctccgcatggtcgaattcatctttgtacagatcgtcttcttcagggtgtctgcagccgaagtataaatgagcttcgcccaggctgttaccggacattttttctgcagcccgcgcctggataaatcccctgaacggtgcaattccggtgcctgctccgatcataatgagaggcgttttcgtaatttcgggcaatgcgaaacccgactgcggcgagcggatgaaacagacggcagaatcgccattttgtaatccggctaaatagttcgaagccacgcccttgtattctccccggccgctccacgccggagccgtcacaacgccgaccgtgatactgagctcccttttgtttgccttcggtgagcttgagattgaataatagcgcgcctttaaggacggcagaagttctaaaaagcgctcaaacggcagttcacacgccggataatcttccagcaggtccagcatggtcattcgttttttcagcacgttttctttatatgccgcatcgtcagaataaagatgctccaattctttttggtgcggcgggcacacggtatgggcggcaagttcgcgaagctgggctctcgttgccggttcctgcagctctacatatgacgccaaaagctccggcgcattaaccggccggtccatcggcagatgaggcagctgccggcccttgatcttaaagtgctgatttgggtcgagaccgaatcggcgaatgacacggctgatcagttccccgctgttttgcggaagcaccccgagatggtctccttcccgatacgtttcggtcttcgggagacgcagctcaatatgccggactgaacgcttgctgctttcggtatgaagctctttgtttgtgatgacttccgcctcaaatgctttgtacgttttggcaatcggcgtctcggctgcttcacttacgtattcgattgataactgtgatttgtttgcctgttttggagcggcctctatatgaaaagccttcatgatgtccttccagaatgagtcttcccaggcttcctgactgtactcaaaatcatcggcattgtcgccctccccgatagaagtcagccgttttgcccctttttcttcaagcactttgtctatcaggcggggtaccctctggtaagtggcggcccagttacggtctccgcagccgaagacggcgtaagaaacaccctttaattcctgatcttcaagggtttccatccatttcacaaaacccgccgcattatcaggcggcgccccgttataagaagccgtcacaataacgactgcgccttttacaggcagtttcccggcataatcatcgagcgggccggtttcagttgaaaatcctttgcttctgccgatgtcagccagctcttccgcgattccttccgcagttcctaaatttgatccgtaaagaatgagaagcggcgttccgtgggacgggatttctttcgtttcttctttgtgaccgccgccttcagctttatggttttgtacgggctgatgattggacacgtccttgttttttacacggattttaaaatcaccgggcttaatggttaaagcttctttaatcgtaagctcataatcagtatgatcaatcagttcaaagtgtttaaggacaaggccgagcaccattgtcgcttcctgcagggcaaactgcatcccgatgcatgcgcgctgtccgtttccgaacggcttatacgcatcagccggaattgccgcgggatcgctgaacctttccggacggaatagctcggcatcttctccccacgcgcttttatcccggtgaagctgcggagtcagaatcgtcaccggctgtcctttcgcaatcggatatttcccgccgagaaccgtatcttctttcgcgtacagggaaaatgccggggcagtcggatacagccgtaaagtctcgttcaacaccatgcgggtatatgtcagctgctgaatctgcttatattcaggtgtctctcccgtcagcacccgctcggcttcctgaacggcttttttcaatttatctttatttttcagcaggcagtaaatcgcgaatgaaagcagtccgcttgtggtttcatgccccgcgatcaaaaaggtaatgatttgatagcggatattttcatcatccagcctttcacccgttacaggatctttcgcttcaagcatcaatgctaaaagatcagacagattctcatccggattttccctccgctcagcgatgatccggtctacgagttcattcatcacttcaatatcctgctggaactgatgtctcgttttgatcatcagcttgtcctgcaggctgtgtctctgtgattggcgcattgcctcctgcagcgcgcgaagcatacttgtgataaaaggatgctgtgtgtcgcggtaaaagctgttaaagcggtaatgaaatccgcacaggccgattgtatccagcgtcaggcgcgtcatatcttcggcaacgtcaatttcttcattcggatttaatctgctccacttctgcacaagctgcatggcaatatcaagcatcattgaatgatagcctttcatcgccttctggctgaagctcggcaataaaatccgatgcgctttctgccaattcttttcgtgagtccagctcgtaaatagtccgtcaccgccaaactcacggactttcagcaaggctttgctgaggtttttatcaaatcgcttttcatcacagacttctgccgcgagctcgcggcctgagacgaagaccccgacagagctcggaaattcgaaacgaaagatcgggccgtattcttcggcaattttccagagcgattgtgacagtttttctttttccaagtgagggagatttttcagaggtccgtatgttttcggctgcggtatagcgcttagctgtttcatatcgatcttccttccttcggcgaatagttaatgagttctgatggcatcccaagaacattgttccaattctttcagaaacggttttgttatttcgacgcttcccgtccggataagctgatagagtttgagatatgccccgagcagcagcgccatcagcacattggacggcagattgcggagcacaccttcagacttgccgcgctgaaaaaagacgtcaagcatctgtgttatttcatcaagaagcttacggctcgtttcattcagaaagtaggcgtccttattcgtttcaagaaaaaacaatgcatactcactttccttcgtaaaatcaatcagacaataaaacaggtgatgaaacccttctcttacagagataccctgaaagtccgttttgacttttttcataaaacgctgcgcactttcctgatacagtacgttcacaagtgtctctttactgtcaaagtaacggtagattgtgccggttccgacatcggcctgagcggcaatcatcggaatcgtcgttgcgtcaaatcctctatctgtaaacaaagtaagcgacgctttcataatgagttcaaccttgtttgaagctgtcatttcatccccctttccagatgcggaatgaatattcattccgtttgttcaaaacatttaaaatgtacggtcatctgattaccattgtataagaaaaaaactttttttaatataaaatagatgtgaaataaccaaaaataaggaaatatgcccaatttcacaaaaagagctgcagtgacttaagcagctctttttatttcccaagaaatattctatttaatggcagtaataaaatggaatgaatctctgctgacaactgaaatgtctctgaaatgctgatcatagagcacctcaatcacatccttctcactcatccgcgaaggtttcaaaaccatatagaaacacccgtcaatttgaagaacgcggtacacttctttacatgctgtcctgtaatcgctgactgtttcagcagtatgtaatgagaaaactttatgaaagctgcgatcgcggaacggtaagctttcaggcctcccctgctgaatgtttccgcgcccggcttttataaccgaacggtttgcgcgctgtgttttccgtattttacgtttcgatgtttctatgcttttaagactgcccttttcaagctgtccgatgatttgtttaaacattgagccgtttccggtcccgatttccaaaatgcggtcgtattcctgtatgtccatcaagatttgctgaatgactgactctgccagttctgatgcagcaaagtatttcgcgcgcattcgttttaatgctgaagatgtatgttgcaacattgtataacacccgcttttccattcctgtgatttattattcagaaataatattacctcgtattagtatgaggtactaactagacgcacttctcttcatgaacgtttcgatttatttgaaatttatatttgttttcataaaaaaaagacggaaaacgtaggttttccgcctgctctagtaccaataatacggtgctatatatcttgtctgccgggaaagcgccgccattctctgccggcgatacgggttgccgtagccgtgtttaaatgaatggggcattgacgcatacccgtgcccgatggatggaattctgttctgaccgccttgcatgctatcacccgcttaccaatttttctttctttaccatggtatgcaggccgtctgcgacgtgacagcaacatcctcgctaaacctggtccttctccattgtgtaatgattcagcagttcaattctgaacatgatgatctcctccttctcctccgttttggcccttcgtgtccgttcagttcatataaaagtgtttcagctggcgttctttcgcttcattataaaactcttcgacctgctgttctcgttcatactcttccgcacttttaaaacgctttgaaatggtcagtgttaaaaagaaaagattaatggtcattatcgctcaccccctttcaatatccgcacaagcgaaaataacccgcagcaaacttcatatgcgctgcgggcagactaaatccgcagacaaaagaagacgtgcttctttccctgcggggagctgcgaatgtcctgatactccgaaattaacgtgcttgacgggcagaggttaaggaaggacacgaactcttccacaggctgaatcggttcaattgtaaattttgattgccgtttaaagtcgtcatgtgattcaacctccctttgcttttttcttactttgtaagtatatccatcagcttccattttgtaaacatttttttcaagatttggacggaaaatgtgctggcattccgcttcaattgtccttgttttccggcatctttcttacctcaggaaactcttttcatcccttgctttttctgatctttttttgaatatgcaataaaataaataaggccgacaaacactgccccgccgattacattcccgataaaggccggaatgagattgccaatcagatcaccccacgaaaaagaacctgcaaaaatcgcagccgggatgataaacatattggctacaacgtgctgaaaaccaatcgcgacaaacgccataatcggaaaccatatacccgcgatttttccggctccgtcttctgcgccgaaagaaagccagacggccaaacagacaagccagttacagccgatcgccgaaacaataacttttccaaacggcatatccaatttgccttgtgcgaccgcaatcgttttttccaagtaaggtcctgtttcggttaatccgacaacatgtccgaaaaagtaagcgacaaacagtgcgccgacaagattcatcaacgtcacgatcacccaatttttcactaatgcaccggcggatattcttctggaaaaaagcgccatagataccgacatcatattacccgtaatcagctccgcgccggcaagaacgacgagcaccaatccgatgggaaacacggacgccccgattaaactcgacaagcttccccattctttcggaaggtcgccgatgacacggatatcaagcaaataaccgagtgcgataaacgctcctcccaaaaatcctaatacaatcagtgctgaaagcggtgaatgcaccttttttacccctgattcgaccgcaagctccgctatttcgtccggtttacgaaaagccataataacccctccatttatcatttcagccccgcagtttccaaagacgcctaacaaaaaaggcagcattcaaacagcccgtctaaaacgggtttgaatgctgcctaacttgtatgcatacccatacaacaatatcaagcagaatgaaaatatcagctatagaaaatgtacagatcatgcacacattccataaaattcgtccttaagccactgcaggcagttcatatcatatcaaatgtgacaatttcgtgtcaattgaatttttttcagcttttgatttcttcacggcgctcttcaattgttcggtcaaagacaaatacagacaccgcaatattctcttcgatcttgatgtctgaaaacagatgcacgagctttgctccgatgagctcttccattccgtcaggcgtttgttttgaatacagttcctgaattaagctggtccgcgccgcatgaaccatttctcttccttcaggcgtgcgtgcgataaactgctcacttgcgcttagattgccgtaaagcgttgataccgccatgttatccacaaaaacggtgtgaattcgttccggcccctttccaaataattctttgcgcaatttccggataatatcgttaaattcatgaatttttttagacatattgtcccctccgattttagcctatgaaagacattcccggttcccctttgtgacatttcacctggttaaagttttcctttcgtattgtattataataaatatcaccttataataaaagcagtgaagatggatttgtaataggaaacgtgttatgagtctatcgttttatacaaataggattggtctgttagtaagacttgctagtgaactattccgccatgcgtatttataccgttctccggacaggaggccggtatctatgtgcatggctttttttcgagtttaaaagatggaggggaattggaagtgacagacgttcagtctatccgtgtcaaaattgacggcacggagtatgaagcaccagaggggtctaagattttagatattttaaaccaaaacggaattgagattccgcaaatatgccatgtaccggaagtagatccgattcaaacatgtgacacctgtattgttgaagtaaacgggaaattgcagcgctcttgttccacggctgcagaaaacgggatgtccatctcgcttacgtcgggaagggtaaaagaggctcagacagaggccatggaccgcctgctcgagaatcacctgctttactgtacggtatgcgataacaacaacggcaactgcacactgcataatacagcggaaatgatgggaattgagcatcagaaatatccgtatacgccgaaagatgattcaaagtgcgcggttgatatgtctcacccgttttaccgctatgatccgaaccaatgcattgcctgcggccaatgtgtggaagtgtgtcaaaaccttcaggtgaatgagaccctttcaattgattgggagcgcgaccgcccgcgggtcatttgggatgaaggcgtccccattaatgaatcatcctgcgtcagctgcggccaatgtgtcactgtctgcccttgtaacgcactgatggaaaaatcaatgctcggccaagccggatttatgacaggaataaaagaagatgtcatggaaccgatgattgatttagtgaaaaatgttgaacccgactatacaagcatcttcgccgtgtcagaagtggaagcggctatgcgcgataaacggacgaaaaaaacaaaaacagtctgcacgttctgcggcgtcggatgctcttttgaagtatggacaaaaggccgtgacatccttaaaattcagcctgtttccgatgctccggttaatgcgatttccacttgtgtgaaagggaaattcggctgggacttcgtaaattcggaagaacggattacaaaaccgcttatccggaaaaacggcgcatttgttgaatcgtcatgggaagaagctcttgatcttgtcgcttcaagactcggttcgatcaaggccgaacacggaaatggttctgtcggttttatttcttcttctaaaattacgaatgaagacaactacgttattcaaaaattagcgcgtcaagtatttgaaaccaacaacgtggataactgttcacgctactgccagtcaccggcaacggacggcttattccgcacagtcggtatgggcggtgacgccggcacaattaaagatatcgcaaaagcgggcctcgtgctcatcgtcggcgccaatccggcagaaggacatccggttctggccacacgcgtgaaacgtgcacataagctgcacggacaaaaattaattgttgccgatctgcgcagaaatgaaatggctgaacggtccgacctctttatcagcccgaaacaagggactgaccaagtctggctcatggcagtgacaaaatatatgattgaccaaggctggcacgatcaagcgtttattgatgagaatgtcaactactttgaagattataaagaaacgctgaaaaagtatacattagaatatgcggagcgcatcaccggactttctcaggatacgatcatccgcattgccgaaatgattcgtgatgcagacggcacttgtgttctttggggcatgggcgttacccagaatacaggcggctctgatacatcagcggcgatttccaacctgctgcttgccacaggaaactaccgccgtccgggcgccggagcttatccgctgcgggacataacaacgttcaaggcgcttgcgatatgggaactcttccaggctggcttccggggtatcagcatattaccgatgatgcggcacgcgctaaattcgaaaaagcttacggtgttgaaattgacggcaagccgggtcttgataatattgaaatgctccatgcgattgaagaaggaaacatgaaagccatgtatctcgtcggtgaagatatggcgctcgtcgattcaaacgccaaccatgttcatgacattttatccagccttgatttctttgttgtacaggatattttcctttcaagaacggcgcaatacgcggatgtcatcctgcctgcggttccatctcttgaaaaagacggaacatttacaaacacagagcgtcgtgtacaaagattgtatcaggcgcttccgacactcggcgatgccaaacccgactggtggattattcaggaggttgccaatcgtttaggcgctgattggaattacacgcatccaagcgacattttctcagaaatggcgagcctttctccgctgttcggaaaagcaagctacgacgttcttagcggctggaacagcttcctgtggggaagctttacgggagagagcactccgcttctttatgaagacggctttaacttcccggacaaaaaagcccgttttgcgctgagcgattgggtggagcctgccgtattccctgaagaatatgacctgcatattaacaacggacggatgcttgaacatttccacgaaggaaacatgacaaacaagtcaaaaggcattcagtctaaagttccggatgtatttgttgaagtatcgccggagctcgcggctgaacgcggaatttgcgacggaacaatgatccggctcgtctctccttttggggcggttaaattgaatgcgcttgtgacagaccgtgtccgcgcaaatgagctttatctgccgatgaactctacagataaagattctgcgattaatttcctgaccgggcctgcgtatgattcacggacacatacacctgcctataaacagacaaaagtccgcatggaagtgctcggttcctgtgatacaccgccgcttccgaaaacgaatccgcggaacaaaaaacgtcatccgcaaaacggtgtggaagctcagcgaaaatggaaccgtccgggctatgtgcacctaactgattaaggaaaggaggaaacataatggcaagcccaattactgaaattcaaaaagaaacgaaaacagaggaacagctgaaagctgaaaaactggaagaactgaagacgcttctcgcagaaaatgaagaagccgtcgcgaaaacgatgtccattatggcagagctgaatggcttgggcatttttgatgccgccggctatatgctccaggcaaaagaggagattgccaaaatcgcactcggacagatttcccgggaacctgtcaccaatctcctgaatacgatgatggccgcgggaggcgcgctgtcaaaagctgatcccgaatttatgggcagacttttagaaagcgccatggccgggacggaccaggcgcaaagatttttaaaagaggacaggaaagtcagtatgtttgaactgatgaaagccgtcggtgatcctgatattaaccgcgcgctcggcttcgggctgcagtttttaaaaggaatgggaaaagaattacgcgaaaccccttctgaataagaaatgaaaaagccattgtcaaaagacaatggctttttttattcttcggcctcttccagcctctttttataaataagtgaacggtcaacgcagaaataagcgcccgctaaaaatgcacaatccgttacaaacatcagcattttctggcccgcagtcagcccttgtccgggaagaaccgcgccgatataaatgaaggtgctgactgcaagcagaataaatgcgtaatgcttaaaatcttctattaatgatttcagtcttttcttctccatataaggtcacctgccagttttatagtctaccaacattataatacaagctgacagccgacagagaatgtaaatctatccattctttataaaagggaatcaagcgcctgtttcacatccgccgttaaatcctcagtatcctcaataccgactgagatccgtacaagcccgtcggtaatgccaagcgcaagccggcggtcgcgcggaatcgaagcgtgcgtcattctggacggcacggagattaagctttcaaccgctcctaagctttcagcgattgtaaacaggttcaatttttctaaaaacgcgtcgacgcgttcactgctgccgatatcaaaggaaatcattccgccgaaaccggagctttgcgcttttgtcagctcatggcccggatgtttcgctgatcccggatagtagagcgtctgaacggcatcatgcgcttcaagcagctcggcgattttcccggcgctgtgattgatggcatccattctgagtcccagtgttttaatgcctctcattaaaagccatgaatcctgcggtcctaaaacgccgcccgttgagttttgcacgtaatgaagcttttcaccgagctctttatcagccgtcacaactaagccgccgacgacatcgctgtggccgccgagatattttgtcgcgctgtgcagcacgatgtccgcgccaaagctgagcggctgctggaaatacggcgtgtaaaatgtattatcgacgataagcaatacgcccgcttcttttgcgatgtcagacatcagtttgaggtcagtcactttcaatagcgggtttgtcggtgtttcgatataaatggctttcgtattcgggcgaatggcctttttgactttttcttcactgctcgtatcaacaaagtccgcttcaataccgaagcggttcagcacacctgtcatcacccggtaagtgccgccgtatacatcatccgtcaaaataacatgatcgccgctgtcaaacagcatcatgacggcagtaatcgcagccatgcctgagccgaacgcatatcccgccgcgccgccttcaagctccgcaattaagctttcaagcgccgtccgcgtcggattggccgttcttgaatattcataacccgtatgctcgcccgctttcggctgccggtacgtgcttacttgataaatcggtacggaaaccgctcctgttttttcatctcccgtaattcctccgtgcaccatcagcgtttttttcttcatcttactgacctccttgaaaaatgtttttgcttatatatcgatcgctgccgtcagggaaaatagtgacgatatttgatccggcgggcgcttttttcgcttcttcaagcgctgcataaagagccgcccctgaagagcttccgattaagaggccttctttctcggccgcttctctgacaagcgaaaacgccgtatcgtcttccactgtgtaaatggcgtcaaaatggttctcgtccatataatcagggataaactccatgccgatgccttccgttttatgggcatgcggctctcctccgttcaggatcgagccttccggttcaacgatcaccgttttgacggcaggatttttctcctttaaataagctgccgtaccggcaaaggtgccgccggaacccgctcctgcgacaaaggtgtggatatccccgccgagcgcgttccatatttcaggtccgatcgttttatagtaagtcaatggatttactcggtttttaaattgcagaacggcataagaattattaatctctctctccagttcaagcgcttttcgaatggctccctgcataccttcttctctcggcgtatgcacgatgtccgctccgagagctttcataatttgctgcttttctctgctgaaatgctccgggacgcaaaaaacggcgcgaagctgatgctttctggcgcacagagcgagtccgatcccggtgtttccggcagtcgcttcgatgataacaccgcccggtttcacctttcccgtgcgtagcgcatcttcaatgagcattccgcccagcctgtctttaatgcttccgcccggattcatcatctcaagtttagcataaaccgctgttccctccggtatatcaaaatgcttgagacggagcagcggtgtatttccgatcagttctgtaatatctgttatcacgttcaatatatgtcctcctcctggaaaagcggaggagaacgagaatcccccgcttagtgaattcgtttgatgacattcaggacaagctcagttgaatgaacggcagcctgttctaaaaatttatcaaatgaaacgtcagattcttttccggcaatatcagataaagctctgatgacaacaaaaggcgttttgaactggtggcacacctgtgcgacagccgcagcttccatttcaaccgcgtacaaatccgcaaatttggcgcgtacgtcttcaacccgcttcggatcattcataaaagaatctcccgtagcgattgtgcctttggcgacttgaatgccgttcagttcagaaaccgcttcctcagtaatactgatcagcttttcatcagctttgtatgctgccggaagacccggcacctgtccgtattcatagtcaaacgccgtcacatccacgtcatgatggcggacatctgttgagatgacgacgtcgcctacattcaatgtatgatgaaaaccgcccgctgagcctgtgttaatcacataatcaggtttgaaacggtcaagcagaagcgtcgtgctgatcgcggcgttgacttttccgatccccgatttcagcaagataacttcgacgccttcatagctgcccgtcgtaaactcacagtgagcgatcatctcttgttttgcgtctttcagtttgcttcttaaaatcgtaacttcctcttccattgctccgatgactgccagtttcatttatacacaatcccttcgatttaccgtttaatcgcctccattatccagacaaagtcattttgctgcgtaaaccgcgcggcaaatccctcttctgaaaagatgtttttcattgtcccgagtgtcggataatgttccgtctttaaatcgtccgctaattgatgatagccgtttcggattgcttttttaattgtttcatcataagcttcatgatctttaaagacggtatcggcaaacactattttatcatgcttctgaaggattgtgccatattgctttacagccgcttgcttttcttcatcggttaaatgatgaaaggcgtacgagctgacgatggtatctatttgaaaaggcggagcgggaaactccagaaaatctccgtcactgaacacggctttgtcagaaagcttgtcagccgccagttttctcattgacggagacggttctacaccaaacacctttttgttcgcggcggctaatttcgccgttaaattccctgtgcccggtccgaactctaaaacgttagaacccgaaagtgcgacgatgctgtcaagaatattgtcataccctttaaaaacatcagcgtattgtttgtctgccccgtgcactgtggcatcataagtcgctgcccaatcttcaaataatggaataaattcacggcccatatttttcactctccataatttataattcctatgagtatagtatggattaatcgtggaacagttcctatcctatcacaaaaaagaatggaagggtactaaaatactttgggattattgcgcaattacggcagaaaggcttatactttcattgactcagaagaaaaatcaggaggatctgtactgatgaattttcaattggatttaatcaaagataaagtagaatttttcgaagcggcatctttgcaggagcttgaaaagaaaataaacgttcagattgaaaacaaccaggcgattatgcttcgcgtccgttctgtatcccatcaggtgacggccgttgacggcagaatcctttacagcgcgtcggtgcatttttcagctgacgtatgacagaaaaaagcagctgaataatcagctgcttttttgcggttattttaacgtttctacttttgtcggcttccagccttttttgtctttccaagtgatggtgacctgatactttttgccgttcgttttgtctaaaactttacccttcgcatcttgcgggcttccattgtttccgagccacagcactgtcatgtgatcttttgacacgcctgttgcgtaagagatggcgtcaagcatttcggaccagtcttcagagcttgagtcatacgtcgccgcatgttctcccgtctgctttgttccgaccgctttccattttgggttaacaattgttttctcaacatcgcttgatgagccgccctctgttatttttgcgcctttaaaaggatcgcttgaatcagagtcttttttgctgctgtcatcacttttcgatgaatcatcgtcttttttgctgtcagagtctgaagatgaatcagatgtgtccttatcctgtttatcttttttgtcatcgtctgatgccgtatcttttttgctgtcttttatgtcttcatcggatgtctgcttcgtcttgcctgatgcaggtgtttcctgcttctggctcgtgtccgctttttcgctcacgtcgctcgacggactgttgatgaagaggctgactgcaacgacgacaataagaatagatacgatagcaattaaaatgttaagcaccatatttgcttttctgcgcttatcacggttttcaaaacgagattgtttattgctcaatcattctgcactcctttatccctcttgctcagcatatattttaacatgggctgagcggttgttctatgtctgatttgtttcattttcatgtacctttttaacaatatcataaaacactgtatttgtcagagccttatcccccggcgtgtccatgtgcagcaccacgagagcgtatttcggcttgtccgcgggaaagtatcccgcaaaccatttgtggtaaagcgtctgtttttcttttgtgaacattcccgtctgggcagttcccgatttgcctgctatctcatacggcagatcctgaaaccttcggccggttcctttcggtgaggtgacgacttctctgagaattttttgaagctgctgcgccgtatatttgtcgatgttttccccttttaacggctgttctttgaatgacgccatcgtcgttttgtttttgtattcaattttgtccgcgattttgacttgttttttctcaccgccgcgcgcgatcgccgccatcatattggcgacttcaagaggcgtgactttcacgtttttttgcccgatcgccgtctgtgcgacggctttttttacggttttgtctttgtcatctccccaaatgaccccgcttttttcattatacagctgtctgaatccgtcttcccggtacagcttgccttcccagcccgcccgctgtgtgagacctagtttctccgccatgttttcaataacggaatcatcttttttgattaatttttccgcaagacttgtaaacgtataattgcagctttgggcaaagctttctccaaaactgagcgtgcctttatcatcccccggctctccgtacaggttgagattgcagttaaaggatgtgcccggcttcacttcgttttgttctattgcggctgcggcgatcaccgttttaaacactgatcccggataaatcggcgtcagcatgtaattttgcagtgtctgctgctttgacatgtcggcgtcaggctttgataccattccgagcacactgcttttttcaatgtctaaaaggacggctccccccttttttaacccgcggtctttcaatacatcttccattgctttttgaatattgcggtcgatggaggttttgacttgcagcggataaaacgcgtttgcttcagccgtatatttgacgtccattccgaataaagggtttccccttccgtcgacatgatacaaaagttttgtgtcctgatccgccagtaaaaactcatcaaatgtccgctccatcccgcttgtcccgatttttgccgtgatcggcagttccttcctgccggggtatttctttttcaaaagctcagggtcctggtttgtcgcgcccaacagatgagcggctatgtttgtttctttgctgtctttcatatatacgccgtaaatgccgggatatttcaaagaattgatatttgccacggattgtttcgtcaaatgttttatttttctgctgttcaggatcaccggtttttttgcttccgtcagcagctgcctgagctccccctgtttcattccgagaatgtctgatacccggtcaaccggccaatcctgcgtcacgagaaagggaaacagtatgacggcaggctgcttttttccggtcagttctttgccgttccgatcaagaaaagagccgcggccgtctgaaataaggacttcttccgtccgctgcttgacgctttcctgaatcagattaatattggattttgaaaaagattctgtaaaaaacagctgaatttcagccagccttgcaagcagaaagaaaaacacgagcagaaaacaaatcacggccgttttcagcctttttgatacgatcataaaaaacacctcatccacattttggacgaggtgtttcattgttaaacggatcttatgaaattttcacaattttcacgagcatttctccgcccggcgtctgaactgtcacttcttcgtccacttttctgccgagcaggctttttgcgattggcgagtcgtttgagatttttccttcaaacggatcagcttcagcgcttccgacaatcgtgtaagattcttcttcaccgtcgggcaattcgatgaatgatacggtttttcccaaaccgactacatttgaaccgccgtcgtcctcgatgattttcgcattgcggatcatgttttcaagcgtcgtgatgcgcccttccacaaatgcctgttcttcttttgcggaatcatactcagagttctctgacagatctccgaagcttcttgcgattttaatgcgctctactacttctttacgtttaaccgttttcaattgctctaattcttgttcaagtttttgttttccttcgtgagtcatcggaaaaactttttcttgtgccatgttccttcactccttggtggttgtccctcaacaataacgtgtgattatgtatgagagcataaacgaaaaaatcaagaatgagaacacagggcagtcctcgttcttctctcccatataggtactgtttatcttaaactgaatgtgtgttttctgcaaatgtttcggtttataaacagggaaagaagggaactgtctcattcccttccagcctatacataatatggtctgagttatttatgtctatgctatggtattacaaaattgcattttgttcaaggatcgtttgaatcttcgtgaccatcagatcaattgcgacgtggttttgtccgccttccggaataatgatgtccgcgtagcgtttcgtcggttcaacaaactgattgtgcatcggtctgacgacggacacatactgctcaatgacagaatcgattgaacggcctctttcgttaatatctctcataatccgtctgatgatacggagatccgcgtccgtgtcgacataaagtttcatatccatgaggtcgcgaagtcttttatcttcgagaacgagaatgccttccagaataatgacatccttcggctcaaccggaatggtttcctcagaacgcgtatgcagtttataatcataaatcggcttttctatcggccggtaattcaaaagctcttgaatatgctcgattaaatagtcattatcaaatgcgagcgggtgatcatagtttgtgttcagcctttcttcaaacggaagatggctttggtctttataataaaggtcttgctggatcattaaaatcgagtgtcctttaaactgttcatagatggaacgggtgacgcttgtttttcctgatccggaacctcctgcgatgcctataactacaggactcttacccattggtgattacttcccctttctcatcatgttgctcggataaatctttttgtctactttaaatctaacgatttgcaggggatggcgggcagcatcaagctcgtttccgtcttcgtcccaaatagtgccgattgtgaatgtgaaattgtcgatttcaggaccgaaaaattccacttcgtcaccttgtttaaagaaattgcgctgctggagcgtcaccatttgagtttcctcgtcatacgcgagcacgagaccggcaaaatcaaatgttgttttctttccgtgttcgccgaacatctgctcttcatacccgggcgtgccttcaaagaaagcaggcgcggtatcccggtttgcacatttgtccagctcatccagccattctttttgaatgacaaagttttcaggatcagcgcagtatgcgtcgatgactttgcgatacacgctgacaaccgtcgcaacgtaatgaatcgatttcatccggccttcaattttcaggctgtcgatacccatctcaatcatttgcggaatggattcaatcaattttaaatctttcgggctcatcgcaaacggagcgtcttcttcgtcataaagcgcgaccgcgtttgcaccgtctgtctgatacaggtcataatcccagcggcaggactgacagcagccgccgcggttggaatcccgggctgtcatgtgattgctcagcacgcatcgtcctgaataagcgatacacatggcgccgtggataaaggtttcgatttcaatgtccaccttttccttcatttctttaatttccagtccgctcgtttcacgggcaagcaccacgcggtcaagcccttcttctttccagaactgcaccgctttccagttggaaagggactgctgtgtgctgaggtgaatttctacgtccggggccactctccggcatgtttcaataatcagcggatcagcgacgataattccggcaacttttgcgtctcccaacgcttttaagtattcttccagaccgtccatattttcattatgggcgaaaatgtttgttgtcacatatatttttgccccgtattttttggcaaattctacgccctctgcaatttcttctattgagaagttatccgcatttgagcggagtccgtattcctgtcctccgataaaaaccgcgtccgctccgtaatgaacggcaatttttaatttttcaaggtttcctgccggagcaaggagttcaggttttttcgtaatgacgcgttttccgtttacgactttggaaatggtttgatttacggctgtcatccgttgcaccctcctttttaatagaccgtttctttaaagaagaatcctgtgtcgatgcttctgttcacaggctgaatgctttcaatccgctctatccagctctcttttttctcttcgtatgtctctcggctttcgaagcacagatcgattgcttctctgtacatgcgggtcacttcagttaagtattcaggagacttcaaaactccgtcgattttgaaagaatcgatgccggcgtccatcaggtcctctaattcatcaatcatgcacacatcgttcgggctcatgatgtgcgtgccgttttcatcttcaaaaatcgggtatttattgccccgttccttgtcatgcagaaacattcccgcttcttttttcttctgttcgatgtccatgacttttccctggtattcgaagtaatggcccactaaagaacgctttgattggaacatgcacgtcatgccgtggatttgaatttcaatttcaacttcggcgttttcttttatgtcaatgatgctgtccatatttaattccttagccagcactgcccgccgtgcgcctttgcgtccccagtaattgcaggaatagtagttggtacccgttgtttccgtgctccagtgcagtttaagatcgggagccgcttcacgcgccgccattaaaacggccggatcaccgaaaacagccgcatcaacgccggcctcctgcaaaaaggcaagatagccgttcagctcgtccactttttcgttgtgaaaaatagcattgacggcggcgtacactttcgcgccttcctgatgagctgtctttacggcttcttttatatcttctcttgaaaattcaccggccagtctcaggccgtatctctgttctccgactaacagggccgttgcgcccgcttgaatgagcggaagaatatcctgtacagaagtcggagtcaccaaaagttcaggttttttcatgatcattcacctcttctttttactgatggcgatgccgtctccgaccggcagtatgaccgtttgatagtcaggccggttcatcagccattggttatattgatcaattttttcaacaagcttccgtcttcttttcggctcaatgtccgagtgattttgtgccaccagtcctttaaacagaacattgtctgtaaaaatgactccatccggcgcaagcatcggttcatagagctcaaaaaagttcgtgtactggcctttggccgcgtcgataaaaatggcatcataaggagccgtgacacggacagactcagaaagttccagcgcatccccgtgcattacgtgaacccggttttccatttcaaagtcttttatattgttcacagcttcttcatagcgtttgtcgtcccgttcaatcgtgtaaatattcgcatccggaagctcaagcgccatccgtatggcggaatatccgattgccgcgccgatttccaaaatgtttttcgcctgttgaatcgacagcatttgaagcagcacttcaatgcccgcttcttccataatcggaacatggtgctcttttgcataggcttcaagctttttcactttatcaggccgaggcttcagcatcgcgtttatatactcgtttatttgttcataccgatcattcacggcaaacagcctccgttctaaaaaggagtgcccctgacgaatccgcggggacactctcttaagacacttctttatccataagtaaacaacccgatatattttatcataaaacctttcagaatggaataaaaggagagcttttgccctccttttattcgctgtcttttttggaaatatacttttccttcgctttattatggtcttttaatgttttggtgaaaacgacctcgccgtttggttttgcaaggaaatagagataatccgttttgtcagggcggagagccgcttcccatgatgaatcaccggcatttgcaatcggtcccggcggcagccccttatgtttatacgtattaaacggagaatcaattttcaggtctttgtagtagacccggcttttatgcttaccggccgcatataataccgtcgggtcagtctgcagcggcattttttctgcaagcctgttgtaaaaaacgctggcgattttgtgacggtcggctttggcggtggcttcttcttcaataagcgatgccatcgtcagcgcgttatggacggaaagtttctttttttccagttcagatttatacgtttcgatacgggtatttgtttcctgaaccattgccgtcaaaatcgtgtcaagcgatgcatccggatcattaaacggatatgtggccggatacagatagccttcgagcggatgcttgagcttcttgtttgaaagtgcgtccgttattgtatcaggaaactgttttttcagtttgccgatgaatgttttgtcatccagttttgccatgatctcttcttttgaatatgatgtttcttttgcgatcgcatccgcaatctgtgtaagctgttttccttcaggaacggagatctgaaaggcatatcccgttgatcccgcggtcagttttttgataatcgcatccgcatccattcctttattcaggtggtaaaatcccgcctgaaacccggaagcgcctttatacttcacatacagctgaaatgcttttttgcttttgatgacatgctgatcctcaagaatttcagcgattgccgaaacggaagaaccgctcggaatattaatattgactgccgttttgctgcctttgtcaaccggggacagcagagattttccatagaaaaaagcaccgcaaatgatgataagcagagcgatcacggaggacagtattatcgttgtttttttgtttttacgcggaaatgaatttttagtctgattgatattcatacaagtattttcctcccaacagctcttatactacatgattcatgtgcattcggcaatttattacaaaaaaaagccgaagcgcatatgcgctccggctttttccgttcattttattcttcgtcttcttccgctaaaaacgtgttcagcgtttcttcgatcatttcccactcttcatcggtttcaatcggcatcagttcgccgtcttcaccgttttcgttcggttcgaagcttgaagcgtgaatttcaatttcatcatcgtcttgagcatcaatcggataataaagtacgtaagatttgttgaatgtgtcgttttcaaatgtgaacagcacttcgcaaagctgttcgttgccttgatcatcgacaattgtaatatgtttttcgccgtgttccatttctttcacctcttagtttaaactgtccagatatccttgaaggatcatgacagccgccattttatcaatgactttttttcgtttttgcctgctgacgtcagccgcgatcagcattttttcagccgccatcgtcgtcagacgctcgtcccacagcacaacagggacattgtacgctgtttcaagcagtttcgcaaatgtttggctggcttcgcctctcggaccgatcgtcccgttcatgtttttcggaaaaccgagcacgatcttctctacattatagtctttcatcagctcggataaacggtccagaccgtaatctccttcagcctcgtttatttttatcgtctcaatgccctgagcggtccagcccatttcatcgcttaaagctacgccgagtgttttcgttccaagatcaagtcccaatattctcatgaatgtatttacgcctctttatgctgttctagataggattttaccaattcctcgattaattcgtcacgttccagtttgcgaattaagttccgggcgtcgcgatgcctaggaatgtatgcaggatctccagacagcaagtatccgacaatctggttgataggattgtaccccttttcctgaagcgcatcatataccgtaatcagcacttcttcgacgtttgtttcagcagaatcatcggagaaattaaatttcatcgttttatcaaacgagctcaccgttttgcacctctttcccaaattcgcaggcaaagttcagcctgaggtcctcatcttatcatcattctacactagttgaaaggattataaaacggattttatccaatcttccgcagatgcgagcgcctcttccaatttttcaggctgctttccgccggcctgcgccatgtccggacggcctccgcctccgcctccgcagacttcagccgcttgtttgaccattttgccggcgtgaaggcctttttcaatcaggtctttcgtcacgcctgctgaaaggttgactttctcgttttgcacggcgccgagaatgatgaccgcagaaccgagcttcgctttcagatcatccaccatagtacgaaggtggttcatgtctttcgcatttactttttcagccagcacttttacgccgccgatgtcttttacttttgacagaatggctccggcttccacattgccaagtttgctgagcaatgattcattttctctttgcgcttccttcagctccgcttgaagagactgaattcgcttcggtacgtcttttacgtttgatttcagctcatccgcagcgtgctgcagaaggctgagctggctgttcatttcctgataagcgccttttcctgttacggcttcgattcttcgcgtacctgcgccgatccctgattcggatacgattttaaacagaccgatttcagccgtattcgtgacatggcatccgccgcaaagctcaaggctgtaatctccgacttgtacgacgcggacgatatcgccgtatttctcgccgaacagggccatcgcgcccatttctttcgcttcattgatcggtttcaaatcaatcgctaccggaatgctctcccagattttttcgttgacgattccttcaatgcgttcaagttcttctttcgtcacttgaccgaaatgagagaagtcaaaacgcagacgattttcggtaacgagtgaacccgcttggttgacatgtgtgccgagaacgtctttcagcgcctggtgcagaaggtgggttgctgtatggtttttcaccacaccgcttctcatttgatcttcaacttcagccgtcacgcttgcgcctttttgaatcgtgccgctatccaccgtgccttcgtgtacatgctggccgttcggagcttttttcacgtctttaatggttacgacagcctgctcgcttctcagcactcctctgtcaccgatctgtccgccgctttcagcatagaaaggcgttttgtcaagaagaatttggacggtatccccttcatgcgcctcgctgattaattgcccgtcatgaagaagctcgatcaccttcgcttcagcttttacggcactgtagccgacaaatgtgctttctgcggtaatgtcgcgcaatgcgccgccctgcacctgcatgcttcctacatcttggcgcgcatttctcgcccgttcacgctgtttttccatttcggcttcaaagcctttatggtcaaccttcatttgctcatcttccgcgtattcctccgtcaattcaaccgggaatccgtacgtatcgtacagtttgaatacgtcttttccggagatgatgccgctgcctttttccttctctttctttatcacgtcagataaaatggccagaccttcgtttaatgtttcgtggaagcgctcttcctccgttttgatgactttggcgataaactcttgcttttctttcacctccggatagaaagcgtccataattcctgcaacagtcggtaccagctcgtacataaacggacggctgataccgatggttttcgcgtatcgcactgccctgcgcaagaggcgtctcagtacatacccgcgcccttcatttgacggcagagctccgtcgcttaccgcaaatgcgaccgttctgatatgatcggcgatcactttaaaggccgtatccttcattgcgtcctttccgtaagcatctccggaaatgcgctctgttgcttcaataatcggcataaacaaatcagtgtcaaagtttgtcgggacatcctgaatcacggagaccatccgttcaagccccatgcccgtatcaatgtttttcttcggaagcggtgtgtacgtgccgtccgggttgtggttgaactctgagaataccaggttccatacttcaagatagcggtcattttcgccgcccggatacaattcagaatctgacgggtcattaccgtatttctcgccgcggtcatagaaaatttccgtattcggtccgctcgggccttcgccgatatcccagaagttcccttccagacggatgattctttcttccggaacgccgattttttccgcccatagcgtataagcttcttcatcctcagggtgaaccgttacagacagcagctccggatcaaagccgatccacttttcgctcgttaaaaactcccatgcccacgtgatggcttcttctttaaaataatcaccgatggaaaagtttccgagcatctcaaagaacgtgtggtggcgcgccgttttccccacattttcaatatcatttgtgcggattgatttttgcgcgtttacaattctcggattctccggcacaacgcggccgtcaaagtactttttcagcgtcgcaacgccgctgttgatccacagtaaagacggatcttcatgcggaaccaatgaggcgctcggttcaacggcatgacctttttctttaaagaaatctaaaaacatttgacgtacttcagcagaagttaagtgtttcatctatattcctccttatcactacccgaaattctcttttgcgacagcaaaaaagctctctccctatgcaaaccatgcgttcacacagggacgagagctgtctcgcggtaccaccctgattacaggccgaaaaaggcctgtcacctttcatcccgtaacgcaggattgcggcagcctttaactgcactcaggattagcttcggccgatcttctgctgaagctcctctcagcgtatcggagcttctctcttaaacagggcttcggcgtactcttatccgtcactcgagattcgtatgtattctactcgaaattatagacaagcagaacccgaatgtcaatgttccgtcctgatccgcaaaaagtgaatggccgtcacttttaaaacggctgccgccggaacagcgagaatcatgccgggaatgcccgcgagctctcctccggcaagaagcgcaagcatgatcacgacggggtgcattctgagacttcgcccgacaatgagcgggctcaaaatgtttccttctataaattgaagaataaaaatcgtgacgattacgatgatcacagccttggaggaaatcgccagcgaaaggagcagcgccggcacagcgccgataaacgggccgaaatacgggatgacattcgtaatcccgatggcaaggcccaaaatcagcgggtaaggaagcccgaagagccaaaatgaaacgccggctattaacccgagcaaaaaacaaacgagaagctgaccgcggatgtaatcaccgagagagtcgtccacatcccgcagaaattcactccccctttttctccaggacttcggcgtcaaataccagaccgtctttttcatgacgcctatatccttcaccatatagaacacgagaaaaggaatcgtcgccgcgatcaggatataatcaagcacgaaacggatgcttctgatcgtgctttcaatcgtgccggcaagaaacgtttctgtctgctgaatcattttgtccatccgatggtgcatgccgtcaggccaatgatccgtgtgattatgcagatgcctcagcatgctgttgtagttttcggcaagaccgggaatgctctcagacagatcctgcagctgttcaattaaaacaggaacccctttataaaccccccagccgattccgccgaaaaacaggcaataaatcagaagcaggcttaaagttctaggcatcccttttctatgaagccattcagtaatcggaagtaaaagataagcaataaatactgcgatgaatataggaataaagagagattttataacaagccaaatgggagaccataacatatcgagcatgcaaaagacatacactgttaacaaaacgagcagacatacagctgtccacattaagagctgcagcggtttttgaagcatgacgtttcacctcttgctttatcttttgacagaaagccggaattattcccgtttcataaactacgccttatgacgcagacctcttgacggaaataattatcagaaattacgaaataatctaaataatattcataaaagtctgtataaccatcgtaatgtgttaaaggatttcaaaactgtccagtcaatatgactcatgtttttttaaggaggatggccatgatttcatttcaggatgtaaataagcactacggacatttccacgtgctgaaaaacattaatctgcacattaaaaaaggggaagtcgtcgttatcatcggaccttcaggatcgggaaaaagcacgcttctccgctgcattaatcagctggaaacagttgatggaggcgccttaacggtaaacggcgtctccatccgtgacaagaaaacggatataaatcaggtccgccggaatatcggcatggtgtttcagcattttcatctgtacccgcacaaaaccgttctgcaaaacatcatgctcgcaccgatcaaagtgctcaagcaatcaaaagaagaagcaaaggaaacggccttatactatttgaaaaaagtcggtataccggacaaagcggacgcttatccttcacagctttccggcggccagcagcagcgtgtcgccatcgccagggggcttgcgatgaagcccgaaattatgctgtttgatgaacccacatccgcgcttgatccggaaatgatcggggaagtgctggatgtcatgaaaacactcgcaaaggaaggcatgaccatggcagtcgtcacacatgaaatgggattcgcaaaagaagtggcggaccgcatcgtgtttatcgacggcggatccatcttagaagaagctgcaccggctgaattttacgaaagcccccgtgaagagagggcgcgtttattcttaagccgtattttaaatcactgaaaagaaacggaggagcgcttatgtcacgcgcaacaaaatggttgtcattcggattgatatcactgctggccgtctttatgctggcagcctgcggagggaaagaaacgtccggggattcaaaaggaacgggaaaagacacgttagcctctattaaagacagagacaaaatcatcttcggcgtcaaaaccgatacgaggttattcgggctgaaaaacccaagctccggtgatattgaaggcttcgatattgatatctcaaaacagctcgcaaaagatattctgggggatgagaagaaagcggaatttaaagaagtgacgtcaaaaacgaggattccgatgctgcaaaacggcgatatcgacgccatcaccgccacgatgacgataacggatgagcggaaaaaagaagttgatttctcagatgtttattttgaagccgggcaatccctgctcgtcaaaaaaggaagcagcatcaaaagcaccgaagacctgggaaaaggctcaaaagtattggcggtaaaaggctccacttcctcacagaacatcagagaaaaagcgcctgacgcctcagtgctggaatttgaaaattacgccgaagcgttcactgcgcttaaagcgggacagggagatgcgctcacaaccgataatgcgattttatacggcatggccgatgaaaataaacaatatcagctgacgggcgaaacctttaccgatgaaccttacggaatcgccgtcaaaaaaggccaatccggccttgtcaaagaaatcaacgcctctttgaaaaaaatgaaagccgacggcaggtacgaaaaaatctataaaaaatggataaaagaagaaccggcaaaataggacggaccgcgggatgagcatgcatgctcatccccgttttataaggagtgacatagatgaacttttcaattttaacggaaaacttcgatatgtatatggacggtttcctgcacacattgcttgcgagcttcatcgcgctggcaggcagctttgcgctgggcgttctgatcgcagtcatgagaatcacggctttcaaaccccttcaatggatcggcactgcgtatgtggaatttatccgtaacatcccgcttctcctcatcacattcgttttttatttcggacttccgaacgccgggctgagactggacggctttcaggcgggaacgattgcgcttacgatttacacgtccgcctttatcgcagaagccatcagagccggaattcagactgtccccaaagggcagatggaagcggccagatcgtcaggcttcacctacagtcaggcgatgagatatatcattcttcctcaggccgtaaaaatcgtcattcccccgctcggaaaccaatttctcaaccttgtcaaaaactcatcaatactcggagtggtggcgggactcgatttgatgtatcaggcggatctcgtgtcctcgagcactcttgtcgtgtttgatgtctatattttcgtcgcgcttttttatttgatattaacgatcccgctcagcatcggggttcactatttggaaagacgtctcggaaaaagttattagagaaggagagtgaataacatggattttagcggcgcctatacacctgaccatctgctgtttttatgggacggctttttggtcacactttatgttgcgctgatctccattgtcctgagttttatgttcgggcttgccgccggcactttgcgctatgcgaacattcctatcgtctcgggcattatagcggccattgtggaaaccatccgcaacctgccgctgttattaatcattttctttacgttttttgcccttccggaaatcgggatcaaactggaaattaccgcggccgccatcacggcgctgacgatttttgaatcggccatgctgtcagaaatcatcagaagcggtttgcaatccgttgacaaaggacagattgaagcggcgcgttcttcaggactgacgtacacgcagactctttttctcgtcgtcatgccgcaggcgctcaggcgtatggttcctccgattgtgagccagtttatctccttattaaaggatacgtcacttgcggtcgtcatcgctctgcccgaactgattcataacgcgcagattttaaacggacaaagcgctgacggggggtattttttcccgatctttctgctggcggccctgatgtatttcgcggtcaattacagcctgtctctcgctgccagacggctggaagcgagacaaacgtaaaaaggatacttccggagaagtatccttttttccgcttaaaacattttcatgactcgtcttctcatccgtttcataccttttttattcagcatatcggactgagaagccatacgatacataacggctccagcccctaaagccaacagagaggtcattgttctgcccatcgcgcgtatctcctttcaactttaaaaattgatactgcgttcgtcttcagaaaacaaatcatcaagactgcttaacgtgccgtcttcctctacttgatgtgtcgcaattttgcctttggccaccgtcagctcaatgaagcagccccagcaatagtattggtttacgccgattttgccgatatctttacttttgcagttcggacatacaagcacagactacacctcttatccgttcaggacgatgccttctttccccgcttcaataagcatatcggcggcgcggcgcacttggcgtctgccagccagatctgaaaagaagccgtccgagagttcatatgctacgattatgcccctgtccaaacaaaagtatacatcttccagcaaaccgaacatttcaccatcaggcgatttcaccggctgcattttaatctgttcaaaggtgaaacagctcttcggcaaaggctgcaaatgagcatgaccggcagctacggcttcttgatccatctcttttatatcacttgcccctaaaaaaagatgacggttgtgaaacaggcgtttctgctccagcacgaaaccgagaaaccggccgtccagagagaaacatacatccgatatcatcccgagactgcgcccggtgttttcgtcatatactgttcgtccttcagctgcatggcatgttctcaaagtgtgatcaaccaccttttgttgaacacgtataggttttgccaagaagccaggcagcatactttgaaatgacttccacaggcgaaaacccggcgcatgaacatgtgccgggttttatttacgctttttcttccataaagtcaaaaggcgtgatgccttccattccgatgttcgcatcatatacactgaacggcagctctttttgcagggcggccagttctgcatccatctcttcagtctgctctgtgagcctgtttttaagcgacgtctgtctgacggtggcatcattgtttttgacgccccattcaagcgcttcttcttctccgcaaagaatcagaaattttttcgctcttgtaatggcggtataaagcagatttctcctgagcattcgatagtagcctttgacgacaggcaggacgacaatcgggaattcgctcccctgcgacttatgaatggaacagcagtaagcgtgggtaaactggctgaaatcctttttcgtaaaggtgatttcgttgccgtcaaacgagacgacgaccatgtcttctttttccgtattttctttggcataaaaaatggacacgatttcgccgatatcgccgttaaacacattgttttccggctggttgacaagctgcaatattttatcgcccgtcctgtagacgacatctccgaatttcagctcccgccttttttctttaggcggattcatgatgtcctgaagaagcatattcagctcgttaattcccgcttttcccctgtacatcggggcaagcacttgaatatctctggaggtataccccttttttaacgcattcgagacgacctgatccacgacttctttaatctgtgaagaattacagcggataaatgagcggtcctttgtcggcgcggtcagcccctttggaagcagtccttttttcatatcatgggcaagttccacaatggatgatccttcagcctgacggtaaatatctgtcaggcgcacggtcggcagcacttcagaagccaaaagatctctgagcacctgccccggtcctactgaaggaagctggtcttcatcaccgacaacaatgagctgaatgtgcttaggaagcgccttaaacaaatggctggcgagccagatatcaagcatactcgcttcgtctataatgatcagtttcccttcaatcggctgatcttcgttgtaggtaaagccttcagcgccattccagccgagcagcctgtgaatcgtaacagccggcagacccgtagattcgctcatccgttttgcggctcttccggtcggcgcggcaagcagcaccggaaacgcctcgtcttttttataatcaccggggtcaagggatacgccgtgcagttcactgtataattccacgattcctttaataacggtcgttttccccgttccaggtccccggtcagtaaaagcatcggtgaagacagcgctttttgaatggcatccttttggcttggtgcgtattgaacattcatccgttcttccagttcaccgagtgcaagcagaaattccgattcaggaaattgatcggcatactccgtctgagccgcaatgtcgagcacgcgttttgcgacgttttgttccgcgtaaaacaaggagggaaaatagcagcgctctccttcgatgacgatatccttactctccccgagggcgatgatgccgtcagccgcatccatttccgtgacgcggccgccttcagctgactgattcaggagcgtttgcgtattgataatcagctgctttgtctctatgtacgtatggccctctgaaagacaggtcgattcaatcgtatataagattgccgctttgatccgctccgggtggtttcctgacagacccatttttccgcccagctcgtcagctttcacaaagccgatgccttcaacgtcttttacaagctgataaggattttcctgaattttctccaaggtttccgtttcgtaggcctgatatattttcatggatagctggggcccgaaaccgtattggttcagagagatcataatctgttcaagcccctgatgccgctgcagctctcccgccagtttgtccgctttcttttttgacattttcggcacatcataaagcaccgacgcatcagccagaattttattgagcgcgccgtctccaagctttttgacgatttcttccgccgttttttttccgattccttcaaacagatcacttgataaatagtgaatgattccttcttttgtggtcggaatttcttttttaaagtgttcagcctgaaattgcaggccgaacttaggatgcgtggcagtttttccgtaaaatgtgtaggtctcatcttcttgcagcagagggaagtagcccgttacggatacgaccttgtcttcgatcgcctcagacgtttctgcaaccttgactttcagcactgtatacaggttggtgtcattatgataaatgaccgtatgaatgacgccttttacatacggctgttcttcgatgttcagctgatccacgagccttccctccttttgttatgactgggtgataagctgtttcgcatgaagcgcaagcatatgatcaggctgtatgccgattgcgccttccagcatctcaagcgccttttcacgattttctttgtacgcgtaagcgaccccggcattataaaatgcgtccgcgtggcctggatcctgctcgatcaccgtctcaaactgcgcaagagcttcatccagcatttcttcatttgcaagacacattccgaactggaagcgcgcttccgtgtcattttcgtttaattcaacggcacgctgcagatacggcagtgcaagcttcggccgctctaatttaacgagaacggtccccagcatataaaacaaatctccgttttccattccggagcgaagcgctttttcaaacatatccttcgcttcggaaaacgattctttcatcacatatacgtttcccgcaccgtaataagcggctgccgccgaattgtccaattcaagcgctctgttatagaatgcaagcgcccgttcgagttcgttcacagaagaaagcagatttgcgaagttgatgtacggcaccgggtcttggccgttttcctcaatcgctttcgtaaaagcctctgccgctttttcaaaatcgccctcctgcatggcgtcaatcccgattttattataatccatttttaacttcctttcgctaaaaaaccccaacatgcgagttgaggttttttacatgtgttatacgtaccacagttttgttccgtctttataaacgtcatctatcgttccgccgccgaggcactcttctccgtcataaaaaacgacggcttgtcccggcgtaacggcgcgtacctgcccgtcaaaaatgatttccgcttcatcatcacccgtcattttcaccgttactttgtgatcttcctgacggtagcggaatttcgccgtgcatgtcatttcgccgccgtccatcagaccgggacgcgtccagctgacatttgtcgccgtgatcttatcggaatacagaagcggattatggaatccttgatcaacatacagaatgtttttttcaagatctttaccgacggcgaaccacggctcgccgcttccgccgattccaagaccgtggcgctgtccgattgtataatacatcagaccgtcatgacgcccttttatttctccgtccattgtcatcatatcgcccggctgagcggggagatattggctgagaaacgttttgaagttgcgttcgccgataaagcagattcccgtgctgtcttttttcgcagctgtcgcaagttctgcttctttggcaatttcccgcacgcggcttttttgcagatcaccgatcgggaacatgactttactgagctgttcctgattgagctgattcagaaaataagtctggtccttgttttcatccagaccgcggagcatgcgcactgtatctgcgcttctgtccacgcgggcgtaatggcccgtcgcaagataatccgcgccgagtgacagagcatgatccaagaaagccttaaacttaatttctttattgcacatgacatccggattgggggttcttccggctttatattcatcaaggaaatattgaaataccttttcccaatattgcttctcaaaattgacggcataatacggaattccgatctggttgcagacccggatgacgtcttcataatcttccgtcgccgtgcaaaaaccgttttcgtccgtatcatcccagtttttcataaagattccgattacatcgtagccctgctccttcagcagaagggccgccacggaagagtccacgccgccggacatgccgactacgactcttgtatcctccggccgtttttccatttgcattcactccattaaaaacataagtccgccgttttaagcaagccgtttaacgacggcggcaagcttttcggcggctgtttcgatttgttccgccgtattgccgaggccgaagctgaggcggattgacgaagtcagcctgccgctctcacttccgaacatggccgtaagcacatgggacggaagaacggatcccgccgtacaagcagatccgctggagacggcaatgccttccatgtcaagattgaccagcagcgcttccaccggcacaccgggaaagtaaaggtttaaaatatgaggcaggcatttctcggcatctccgttcacctccgctgtaacgccggcttcttccagcgtgctcatgatgatgttcttaaactccttatacttcgctgttttctcttccctctcacggtttgaaaggacgaccgcttcttttaagccggcgatgcccggtacattttccgtccccgcgcggcgctttcgttcctgctctcccccaagaagaatcggtgacagcttcacctcttgatttacatataaaaagcctgtccctttaggcccgttaagcttgtgaccggaaacagacagcatgtcaattctgctttttttcacatcaatcggcatataaccgaatgcctggacggcatctgtgtgaaaataggcctgatgcccgcttaacagctctccgatttcgtcaatcggctgaatggttccgacttcgttattgccatacatgacggtaacaaggattgtatcatcacggagcgcttctttcacctgatttgcactgatccgtcctgaagggccgggcatgaggtatgtcacctcaaagccgtcttcttccagcttttcgcaggcgtgcaatacagcatgatgctcaacagcggtcgtaatgatatgctttccttcattcttccgggcggcagccgttccgaaaatggctaaattatcagcctccgtaccgccgcttgtgaaaataatttcctgttctttcgcactgatttcgcgcgcgatgtccgctctcgcttcatcgacccatttccgggattctctcccgaatgaatgaatgcttgacgggttgccgaaactgccgaagaaatggggcttcatttcttcgagcacacgttcatccatgggggaagtcgcagcatgatctaaataaatccgttccattgtctttacacctctggtttaaatatagaacatataagcttcctgctcgccgtccgtgtagctcgcaaggtcttctaacgtcgtgctgtccagcacgtcttttacagcgtcgcggatgcggatccataactcccgcttggcaggctcttcatcctcaagcacttctaccgggctgatcggcccttccagcactctgataatatctccggccgttatctcttcaggctggcccccgagcacgtaacccccgtaagcgcctctgatgctttttacgagtccggcgtttctgagcggtgatacaagctgttccaagtaatgctcagaaaggctgtttgtttgggcgatgcttttgagcgacgtcggaccgtctccgtgctttttcgccaattcaatcataatggtgagcccgtatcttccctttgtcgatattttcaatatgaacaccccagtcaattctaattgttaatttatacaagtaaatggatatgaataatctgtttagtatcttatagaccaactgttattataacataacttatcctaattttcattgaaacacggggcccgccgcaattcgcttttctaatcgtccgttttccgttaccctgtatatgtaaggagagatgttcatgaaaccattggcgtatcggatgcggcctgccaatatcgaagacattatcggtcaggaacatttggtcaaagaagataaaatcatcggcagaatggtgcgtgcgaagcacttatcatccatgatcctgtacggaccgccgggcatcggaaaaacgtccatcgccacagcgatcgcaggatcgacaagcatcgcattcaggaaattgaatgccgtcattcataataaaaaagacatggagattgtcgtacaggaagcgaaaatgtcaggccaggtcattttaatccttgatgaagtgcacagacttgataagggaaagcaggattttctgctgccctatttagaaaacggcatgattattttaatcggcgcgacgaccgccaacccttatcatgccattaacccggccatcagaagccggacccagatatttgagcttgaaccgttaacacccgatctgatcaggcaggcattgaaaagagcgctcacagatgaacaccggggactcggttcctacagcgtttcggtggacgacgacgcgatggatcatttcgcacaagggtgcggaggagacgtccgctccgctttgaacgcactggagcttgccgtgctctccacaaaggaatcaagcgacgggacgatccggattacacgggaaacggcggaagaatgtctgcagaaaaaaagctatacccatgataaaaacggcgatgcgcattatgacgtcttatccgcgttccaaaaatcgatccggggctcggacgcaaacgccgcccttcattatctggcccgtctgatcgaagccggagaccttgaaagcatatcaagaaggcttctcgtgatcgcctatgaagatatcggcctcgcaagcccgcaggcaggcccccgggtgctgagcgcgattcagaccgcagaacggatcggctttccggaagcgagaattccgctggccaatgcggtaatcgaattatgcctctcaccgaaatcaaactccgccatttcagccgttgatgaggcgctcaaagacatcaggacgggtaaaatcggcgatgtgccgaaacatttaaaagacgcccactataaaggggcccaagagctcggacgcgggatcggctatcaatatccccacgatttcgagaacggatgggtcgaacagcaatatttgcccgatccgttaaaaaacaagcaatactataaaccgaaacaaacggggaaatttgaagccgccataaagcaagtgtatgaaaaactgatgaagcagaaaaaataaccggacaagatctttcgtgtaaacggcggattcaaataaaaaaacagcctttcctgaagaaggctgtttttctttttacttatctttaacccgtttaatgtcgatgtcctttaagagctccatgacaacatgtccgcccataatcagaccggccactgacggaacccaggcgttggaagacggcggcatttgcgctttgcggattttcgcttcatcattcccgacttcttttctgacgtcttcacggatgacgatcgggctttcatcagaaaaaatgacctgtacgccttttttaatgccctctttacgaagccttgtgcggacgactttggcaatcggatcagtatgggtttttgaaatatcagcaatctgaaagcgtgtcgggtctgttttattcgctgctcccatgcttgaaatcagcggaacattccgtttcagacattctttcatcagatgaattttataatgaatcgtatccgacgcgtcaatgacgtaatcgagcggatactcaaagaactgctcatacgtctcttctgtataaaacatttttaaggcgacgacgtcacaatccggattaatatcagcgatccgctctttcatcaattctgttttcggctgtcccaccgtcgacaatagcgcatgcagctggcggtttacgtttgtaatgtcaacatcatctttatcgacaagcacgatccgccccactccggacctcgccaatgcttcggctgcgaatgaaccgactccgccgacgccgagaacggccaccgtgctgttttttaacgtgtccagcccttcttttccaatcgctagctcatttctggaaaactgatgtaacaagaacctcactccacattctggttttataaactcggcttgtcaaaaagccgctggttttagcgcacaaaaaataaagtcccaattgtgccgttgcagctttccttcgttttgaacccgctctcagcaggtgggtgcccttttttaaatcttgtaagtcctctttagcgaatgaaaagaggcatgtacgccatttaaaaatgcgggctcccaaatcaaaaaaatgttcggtcaaaactaggtgtacaactaacacatcaggactttatttaacttgtcaaaatcatatcacagcagattttgattttcaagaaacaaactgccgatctttactgtttcacttttcttttgacagaaaggtgaagttcttcaagctgggcgtcgctcacttcgccgggcgcttccgtaagaaggcagcttgcgcttgccgttttcgggaaagcgatcgtatctcttaagttagtgcggcctgcaagaagcataaccaaccggtctaagccgagcgcgattccgccatgcggaggagcgccgtattcaaaggcttcaagaaggtatccgaactcctcctccgcttcttcttttgtaaagccgagaagcccgaacattttttcctgaacgtctttttcaaaaatacggattgagcctccgccgagttcatagccgtttaagacgaggtcgtaagcctgcgctttcatatcttcaggcgccgtttcaatcaggtcaagatcttcacggacaggcattgtaaacggatggtgagccgcatagaaacggccttcttcctcgtcatgctccaataacggccagtccacaacccacaggaagttgaagaggctttcgtcaatcaggccgcgttctttgccgagctttaagcgaagcgcgccgagggattgagccacaacctcaaacttatcagcgccgaacaggagcagatcgccttcagaagcatcaagcgcttcagccagttttgcctgcttctcttcatcaaagaatttcgcaatcgggccttttacgccgtcagcttctactttcacccaagcgagacctttcgcgccgtaatttccggcaaaaacgccgagcgcatcgatatcttttctggaatagtcgccggcagcgcctttgacattgatcgcttttacaacgccgccgtttgccacggctgatgagaacaccttaaattcagtatctctcactatgtctgacacgtccgtcagcagcatgccgaagcgggtatcgggtttgtcggaaccgtagctgttcatcgcttcttcatatgtcattcgcggaagcggaagcgatacttcaacgccttttgtttcgagcatgactttcgccatcatctcttccgccagagccatgatgtcctcttgactcataaaggacatttcaatatcaatctgcgtaaattccggctggcggtcggcacgcaagtcttcatcgcggaagcagcgggccacttgataataccgttcaaagcccgacaccatcagaagctgtttaaaaatctgcggcgattgcggaagggcgtaaaattccccttcatgcacccggctcggcactaagtaatcacgggcgccttcgggagaactttttgttaaaatcggtgtttcaatatcaagaaatccgttttcatccaagaaatggcggatggattttgtgacttgatgccgcatttgcaatgtttgaaacatcgccgggcggcgcaaatccaaatagcggtgttttaaccggacgtcttcagaaacgtcagccgcctggtcactgatcggaaacggaggcgttttcgccgtactgagcaccgtcaccgcttcagctttgatttcaattttaccggttttcaggttgggattcaccgtgccttcttcacgggcagaaaccgtgccttcgatatcaagcacatattcgtttctgattgcttccgctgcggcaagggcttccttcgatacgtcagggttgaacacgacttgcacaatacccgagcggtcacgcaaatcaatgaaaatcaagccgccgagatcgcgccgcttctgcacccaccctttcagtttgacggtttcgccaatcgctttttcagttatctcgccacaataatatgttcttccaaacatagcgttcctctccttcactgcttttgatctgcctttaacacttgtatcagctcgtctaacaccacttcacgctgctctcctgtttccgcatcttttacattgattttattttgggcaagctcatcttcccctaaaatcgcaataaaacgtgcgccgagacggtcagccgttttgaattggcccttcatctttttattttcataatcgatttcacttgagatgcccgcttctctcagtttgtacacgagggaaacggaataatccttcgctttttctccgagcgtcacgatgtagcagtcgatcccctgattgacgggaaggtctgttttctcagcgtcaatggctgccagcagtcgttcgatgctcatcgcaaatccgatacccggcgcttcaggtccgccgatctgttcaacaagcccgtcatagcggcccccgccggcaagggttgtaatcgctccgaatccttcggcattgctcataatttcaaaagcggtatggttataataatcaagccctctgacaaggttcggatctatttcgaacgggatgccgagaccgtttaagtattgttttactttctcaaaataagcggctgattcttcatttaagtaatcaagaatggacggagccgttttcatcagttcatgctctctgtctttcttgcagtcaagaattctgagcgggtttgtgtgcagacgcgactggcagtctgagcaaaattctccgatgcgcggttcaaaatgtttgacgagcgcttcccggtaggatttgcggctctcctggtcaccaaggctgttcagcacaagcttgacatgtttcaaaccggctttacggtaaatactcatcgcaagcgcaatgacttctgcatccacggccggatctttggagccgatcgcttcaattccgaattgataaaattggcggaaacgccctgtctgcggacgttcgtaacggaacatcggtccgacataataaagcttcgtcggctgcaccgggttcgcaaataatttattttcattgaacgcgcggactgcggcggctgttccttccggccgaagcgtcaagcttctccctttgcggtcttcaaacgtgtacatttctttctgcacgatatctgtagactcaccgacgcctcttgcgaataattccgtatgttcgaagatcggcgtgcggatttctttatattgataagtgcggcacgtctccctcataatttgttcgacgaactgccatctgtctgattcacccggcagtatgtcctgtgtgcctcttggaatgtgatatgccatgttacaggcctccttaatgtctttcttcaaataaaaaaactcccgctcctactatacatgtatagtagggacgagagttatacccgtggtgccaccctagttggaatgccgaagcatccccgctctgacctttaacgcaggttcacgtccgctgcctaatgacttgcaaaagcgttcagcagggaacctccggagtgttgtttcgagaaagatgcagtgcggatccgctttcagcccgggacggttcctctcttttccatgcattctgacctactcttctccattatcggttcaaaatcgttatcatgagttatgtacatcaatttctattataataatgggattgcactcccctgtcaagttttattccgtctgtttttccttgcgaccgcttctttcgataagagaccgaactccgtcgccgtctcttcaagaaaacccgccttttctctatcgctctgatcactgaagtgcagatttccttccgcatcgtgcagcgcgcgtcccatttttggttgatatttcatgatttgcacaccttttcgctgtatttatgactagtataaacaaaccattttatttttatttaacattcagcaaggaaaatacgatattatacaagaatgtattttagttagttcagaaaggaggacagccatgaagaagagaactcttgctcttattttatgcggcgtcatcatcacagcgcttcttccgtcatttcacaccgcaatcgccgcagagggagaagcggtcatcgcgacagacaagatcaatgtcagaggcggtcccggcctgagctacggaataaaggctgaagtaaaaaaaggggaaagatacccgatcgttaaagaagagggagactgggtacagcttcagctgagccccggtaaaaccggatgggtcgtttcctggctgatatcaaaaacagccgggggagcagacaattcatccgcaaaaagcggaacggtcacttccaccgatcctgacctccgcatcagaaaaggcccggggacatcgtatgaagtcatcggcaaacttccgcaaggcgcgcatgcatccgtgctggacaagaacagcggatgggtgaacatttcttatcaaggcacaaccgggtgggtttcttccgaatacgtcaccgcggacagcggcggatcggatacgaaagcaacttcggcccgaagcgggtcaaaaagcgggacggtcggcgtttcttcattgaatgtcagaagtgcagcgtcacatgattcagcgattatgactaaattatcacgcggaacaaaggtttccatcttaagtgaagaccacggctggctgaaaattgaagcaaacgggcaaaaaggctgggcagcaagccactacatcataaaggattctgactcatcgggcagcgcatccggctcgggagacggttctgcgggctcaggctcctcgaaaaaagcgtatattgtttacggcggcaccaacttaaggagctcggcctcgacttccgcttctatcgtaaaaagggcagataaaggcgcagcctacccgattgtcggctcaagcggcaaatggtatgaagtccggcttgaaaacggacaaaccgcatatgtggcagactgggtcgtacaaacgtcaaaaagcggtgaggaaacaggcgaagcaccttctcccaacacgtcaggcggcagcggctcacttaaaaacaaaacgatcgtcgttgatcccggacacggaggaaaagacagcggaacgatcggctactccggaaagtttgaaaaaaacgtaacgattaaaacagctaagctgttagccggaaaattgagagcggccggtgcaaacgtgtatatcaccagacaggatgatacatttatcagcctgcaggccagggtttcaacctctcattaccggaatgcggatgcctttatcagcattcactatgacagttatgccgatacgtcaacgcggggaagcacggcttattattacagtccgtctaaggaccgccagcttgcctcagacgtccattctgaagtagtgaagcgttcccctattcctgatcgcggcgttctgtttggcgattattacgtcctgagggaaaataaacggcctgccatgctgtatgagctcggctatctcagtcaaccgcaagaagaaacaatcatacatagcggctcttatcaggaaaaagtgacagacggaattgaaagcggattggaacattattttcaatcataaaaaaaaagctgccgaacggcagcttttttattgtttagaatccataatcaatgtaatcggcccggaattcgtcagctgaacatccatcatggctccgaatattccggtttccactttgactcctttttcccgaaggagttcgttccacttttcataaaggagcacagcctgatccggtttagccgcattcataaaattcgggcgtctccctttctttgtttcgccgtaaagcgtaaactgggaaacggataaaatctccccgcccgtatccaaaagcgataaattcatcttgccgctttcatcatcaaatatccgaagattcacgattttatccgccaagtaagcggcatcttcttctgtatcttcatgagtgatgccgacaagcgccataataccgggtccgatccggccggcgacagcgccgtcaaccgtcacactcgcttctgttacacgctgaacaactaatttcatagcaagctccttttagttcattacccgccggactgaatagatgtctctgatctgcttaatccgctcgaccactttgtgcagatggttaatgttttgaataaaaatcgccatatgaatcgtagcgactttattgcggtcggatttgccggagacagaggagatgttggttttcgtttcatttacggcttggagcacctcatttaaaagcccgagacggtcataccccaaaatctcaatctcaacgttatattctttgcgtctttgaacctgtgattcatgctcccattcaacgggaatcagacgttcctgcgcttcattcgttttgacgttcggacagtcgtcccggtgaacggatacaccgcgcccttttgtaataaaaccgacgatatggtcgcccggcaccgggttgcagcatttcgacaagcggacgagaaggttgtcaatgccttttacgcgcacacccgcttcccgttttctcccttgaggataatgtttcggctcggaagtgacttcctgaacgattttttcctgctcttcctggtcacgcagcttccgttctttttcggtgagcctgttggccacctgaagagcggtaatgccgttatatccgaccgccgcgtacatatcctcttcatttgagaaattgaacttgtcggcaactttttgaagattttcgagcgttaaaacatctttcacttcaaaatcaagatttttaatttctttctcgacaagctcacggcctttttcgacattttcttcacggcgctgtttcttaaagaattggcgtattttgtgtttcgcctgggacgtctgcgccagtttgacccagtcttggctcggaccgtaagaatgcttggacgtcagaatctcgacgatgtcgcccgtccggagcttatggtcaagcgtcaccatttttccgttcactttcgccccgattgttttgttgccgatctctgagtggatcctgtaggaaaaatcaatcggcacagagcctgacggcagttcaatgacatcgccttttggcgtaaatacgtataccatgtcagaaaacagatcgattttcagcgattccataaattcttccgcatccgtagactcgttttggaattccagaatttcacggaaccaggacagttttttctcaaatgtcgcttcttcgtttgcagccttgccttctttataagcccagtgtgcggccaccccgtattcagcgatctcatgcatctcaaacgttctgatctgcacttccagcggatcgcctttaggcccgattacggtcgtatgcagagactgatacatattcggcttaggcatcgcaatataatctttgaatctgccaggcatcggcttccagcacgtatgaataatgccgagtacggcgtagcagtctttaatgcttccgacaagaatacggacggcgagcagatcatatatttcattgaactgtttattttgcagcgccatcttgcggtaaatgctgtagatgtgcttcggacgtcctgaaaagtccgctttaatattcacttcttcaacgcgttttttcacttcattgacaacctcttcgacataaagttcgcgttccgcgcgctttttcttcatgaggttgacgattctgtaatattgctgaggattcaaataacggagagcggtgtcttccagctcccatttgatcttagaaatcccgagccgatgggccagcggagcgaaaatctccaacgtctcatttgaaattctccgctgcttttcctgcggaagatgctttaacgtccgcatattgtgaaggcgatccgccagcttgatcaatatgactctgatatcctgagccatagcgacaaacatttttcgatggttttccgcctgctgctcctcttgagatttatacttaattttaccgagcttcgtcacgccgtcgacaagcatcgccacttcttcagaaaatacttccttcaggtcgtcgagggtgacatccgtgtcctccaccacatcatgcagaaatccgcccgcaattgtggaagggtccatttccaaatcgacgaggatccccgccacctgaatcggatgaatgatgtacggctcacctgatttgcggtactgttcgcgatgcgcgttttgcgcatacaggtaagctttctcaacaaacgcaatctgctcctccggcagataagtgcgcgctttatctattacttgctcggcagtcaatacttgttcgttcgccatggaatcaccttttttaaatgtaaactgtattagtttattatcaagaaaaaaacgagagatgtaaagggcagaagttcaaaacacctaaagaatctgtcaggatgatgaaataataggaaaaaagcaccctgacacgagtgcttttttccatatgcggttaatatttcattaatgttaaaatatcataatcgtcaagcttgtctctgccgtcaaggtaagaaagctcgattaagaacgcaataccggctacgacgccgcccagttcttcgactagcttaatcgttgcttcgatcgtgccgcctgttgcaagcaagtcatcagtaatcagcacacgctgtcccggcaggatcgcatctttatgaatcgtcagtacgtcttttccgtactccaaaccgtaatcgactttaatgacctcacgcggaagttttccttctttccgaaccggcgcaaagccgactccgagtgcgtatgcaaccggacagccgataataaagccgcgcgcttcaggcccgacaactaaatcaatttctttttcttttgcatattcaacaatttggtcagtggcgtaacggtatacgtcgcctttgtccatcaatgtcgtaatatctttaaattgtacgccttctttcgggtaatcgggcacaattgttacgtattttttaagatccatctgttctatgtcctcctcgtactttcataagcctctgaaccttggttcatcagcttattcagccattccttcagctcatgggctgcggaataattgagcttctggtctaattccatcagctgctgttttacctgataggtttgcgaatctgccaggtcgcgttttttcgcaccgctcacgacagacagcacaccatcttctattttaacaaaaccgagatcaaaaaacacctttgtcatgaaattgattgtgtcaattgaccatcctctgtgtctcgcaagctctgaaccatgcttgccgaagtcaaaagcgccccttttcaagagaaatgcgtaaaaccacttgaaatcattccgcgatggaaatgaggacaggaaatgttcttcatgattgataaaaacaaaataaatccgttccggcttctttccgtcaagcaaatgctgcaggcgatccgctgacggcggcacatccagaaaaacggcatattttccgtcaagctggagagcttccgcctcggattccgaagtgatctcggcaagctcgcccgtcagctctttttcacggagcttctgagcggttttttcgttaaagctgatgagcacccgtttttccttcggcagtgcggtgaccgtatcttcccacgtccgcttgcctcgaatatcaaaaagctgccattccggcaccgcagcatctttaatcatcagctggggcttctttctgttgttccattcattaatggacatctcgccgacaatggaaatcgttgatccgggaacaactccggcttccagctctcctttgttaaagccgacgcagtcaaggacggcggaatcacttttcaccgtcattttcacgtggtttttattcgctccgatcaggcgcacatcatcaagcacggcatttttcaccatcacatgcggtttagggttaagcatgccgaacggcgacagcatattcaattctgtaatgctttcaacggttatgtcttcaacgccgcagacaagatcaacctcctgaacgggaataaaatcctcttccgtaagggtttcttcagccatttgattcagcctgtcccttaattccgccacatcttcagccttcagcgtcattccggccgccatcggatgcccgccgaaatgaggaagaatgtctctgcactgtgaaaggctcgtaaaaaggttgaagcctctgatgcttcgcgccgaccctttggcgattccctgctcctcatctatcccaagcacaacagcgggccggtaaaaacgttcagccagcttcgatgcgacaataccgacgacacccggattccagccggcttttgccactacaatggcagacgggtttccgccttgctgctgtaccatttcaacagcctcttcggtcatggttttcaccattttctgccgctctttattcagccggtcaatatccgaagccagttcctccgcttcaaactgatcttcggtcatcagcaggtgcacagcgggatcggcctgttctattcttccgacggcattaagcctcggtgcgacctgaaatccgatcgtttcctcatcagcttgtccgatatctccgccggaaagcttaatcagagctttgaggcccggccgatttgtcgtacgaagcctttcaattccgagtgacgcaattaatctgttttcatcatgaagaggcaccagatctgcaaccgtaccgattgccgccaagtccagcatagcttccggcaaagaacccgtaagcgcgtgggcaagcttaaacgccacaccgacgccggccaattctttaaacggatagccgcatcccggctgcttcgggtggatgatcgcaaatacgtcaggaagctcgggtcccggctcatggtggtcggtaataatgacgtctaagcccagctcttttgcgacttcagcttcatggacggcggcgattcccgtatccactgtaatgatcagcgaaaatccccgctcttttatggaacggaaagcttgttcattcgggccgtagccttctgtaaaacggtcgggaatataaaagtcaacgtccgccgacagctgtctgagtgccgtcagcatcactgacgtgcttgtaacgccgtctgcatcgtaatctccgtaaatcataatcggttccccttgagaaaccgccagttttatccgatcaactgcttcccgcattccctttaattcatacgggtcataaaagtctgcatcctttgtatgtaaaaacagccttgcgctttcggcagtatcaaaacctctttttacaagcagtgatgccacaagaggtgttatgtccaattgttctgtgagtgatttgactttttcctgatccggctgctggatttcccagcgcatttttgacgctaacataaattcacccctcaaccaccctattatactagagcggactgaggggtttcaaatgttattctgatccttttttctcttcaagcatttcttccggcggcgcggctgtttttttgccgtccgaatcagccgtcaattcacctgcggatctgttttctttccgcagcattttaatttcgcgcttcagtttcatcacttgaaatataccggctgaaaacacgatcagcgctcccattaacacagagcctaaaatgactaaaatcagcggccattcagcggttccgaacagataatcaacctcaaccgcccgcacgttaatgacagcaaagatggcgacaatcagagtaaatagtaaagcgaatataatagtccattgtttattcatgcgtctgcccccaattattgattcttatcttttcccccattttcccgggagtaaaccccggtctcaggaaatccgggccgttaattgctcgcggaccagctttttcagtccgcttctttctcccgatataacgagggtgtccccttcttcaattacggtatcaatgccggggctcagctgtttttgccggtttttcttcacgatcgcaataatctggacgttgtaatgtttcttgatctccaaatctccgattgtgcggctgacagccggtgcatgagattcggctttaaaccactcaatgacgaggtcatcaagcgcgacttccacagattccagcgctttcggcttatacgtcatcccgcctaaaatagcggaaatctgcctcgcctcttcgtcgttaaattcaacggatgccaagcattcgtcataatcattctcatcgaagtaatagagctcttttctgccgtcatcatgaagaataatactgattttatcgtgatttttcgtaatgacttctactttctggccgatgcccggaagctccgactcacgaacgttcataagaaccccctacatgttttaacaatgatgattgattatgtaagcgtatgtcattatagcaaatgcaggttttaagttcaatgcggcctaaaaaaaacaggctgccttccggaagacagcctgtttccttttactcttcgattgattttttccctttaaattcttttcctttccatacaagccacagctgcgcggcgatgtaaagagaggaataaacgcccgtcaataaaccgaccaataaagcgacggagaagtttgtaattgacgatgagcccaaaatgagcagcacgacgaccacaatcacaacggtcaagaccgtattgatcgaacgtgtaaaggtttgctgcaaactcagattcacgatatgttccagatcggcaaatgacttcggcttgcgttttttcatctgctcgcgtatccggtcaaatgtaacgatcgtatcatttatcgagtaaccgattatggtgagaatagcggcgataaaggttacgtcaacctccagccttgtaatgctgaaaaacgcgacgataaagaaagcgtcatacagcagggatacaatcgcggcgattgccattctgtactcgaaacggattgacacgtaaataatgatgccgattgatgcaattgccacggcatataaagcattacgggccagttcttttccgactgtcggcgataccgtgctgacgttcggttcagatccgtatttgtccttaaagtacgttttgatttcagcgattttttctttggatggctctccgacaaaccgggccgcggcaacatggttctctttacccgagagtacgatgttttccggatccatgccgagagagtcaaagtctttttcaacctgctgcgccgtcaatgcatgattgctctgcacgtcaatccgcgcaccgcttgcaaaatcgattcccaggttgagtttaaagaccagtaagatgataattcccgcaatggttacagcgcttgagaaaataaagaaatattttcgtttgctcgtgaaatcccatttctggaatgccgtatgcggttcagtattttcatctgttttttgaatgtccataatatgttttttcttgacgccgaaccagctttttttccggtcaagccatctgctttccacaagaagggcgagcaggaatcttgaaaggaagacagctgtaataaagcttgtcagtattgacaaaatcagcatcgtcgcaaacccttttacagagcttgtcccgaaaataaagagcacgaccgctgcgatgatcgttgtgatgttcgcatcaaagatcgtcgcaaatgaccgtctgttccctgaacggaaagctgagcggacggatttgccgagtttcagttcttcttttatccgttcataggtgatgatgttggcgtcaaccgccatcccgacacccaaaatgagcgccgcaatacccggaagcgtcagcaccgcctgcatccagtcaaacacttgaagcgtaatatacacgtatacagaaagcgtaatgaccgctatgagtccaggcagtctgtaataaagcagcataaataagaaaacaattgcaataccgatgatgccggcctctaccgtatcatgcaaagcctgctgtccgaattgcgcccctactgaagtagagtatttttcggtcagtttcacaggcagcgcacccgcgtttaaaatattggccaagtccttcgctttttgaacggtgaactgaccttcaatcgtgacatccttcgtgtttaattcctggctcacattcggagcggatacatatttcggatgttttttgccgacttcttttttaaatgaatcgcccttttggtaatcaagccagatcacaagctgattattaggggccattttcttgacttttttcgtcacttctccgaacttatccgcatccttcagcttaacgctgacaatcggttcgttcgtcgtcggatcaaaggtttgcttcgcgccgttttccacgagatcagagccgtttaacagctctttatcattcgtatccctgaacgagagctgcgcttccgttgacagaatttcgcgcgccctgttctgattcgtgacgcccgccagctgaacgcgtatgcggttatttccttcaatctgaatgttcggctcgcttacgccgagaacgttagcccggcggttcagcgcctgcaccgtgctgacgagcacgtcttttgtgattttatcgccttttttgacgggctgcacatcgtacagaacttcaaacccgccgcgtaaatccaatcctaacgtaatattattggcagccggttttgtaaaataccccagccctgtgccgatcaataatacgatcaggaaaaacgcaatcaagcgtccttttttcattatgtatttcctccttaaacctatgccgtcaaatcattatctcagcagttcatccaaagcttcctgaccctcatcgctttccagccaattagacgacttaaaagcttcaacggttgcatagttcataaaatcgccaattttaactgataaaatattaccggccaattcatgcagcggcaattcctttttctgtttccactttttatgtattaagtatgaccataaactctcgtgctcaacatcatcgtatccaaggattttgaactcttcaagtttactgtacaagaaaggccgcaaatgatctttgtacatttcggcgggatgtttctccactgggcgctcgctcctttttccatttttctcgaagacttgtcatgctcggacgacatcggcgcatatctttattgtatatgattccaggtagtttgagaaggcaggggtttataaaatggcaaaacagacttttttaaggggcactcttattctcattgcagccgggatgattacgagaatgctcggctttgtcaaccgggtggttatcgcccggtttatcggtgaagaaggggtcggtttatacatgatggctgccccgacatttttcttggccaccactttgactcaattcggcctccccgttgccatcagcaaacttgtcgctgaagcaagcgcgcggggggaccggcagaaaatgaaacacattttagtgatggcgcttaccgtcaccgggatattaagtctcatcttcacgccgctgtttttatgctttgcgccgattatgtcagaaacgatgctgacggatcagcgcacggttttcccgcttctggcgattacgcccgtcgtgccgattatcgcgatatccagcgtgctgcgcggttactttcagggcaggcagaatatgaacccgctggcgttttcccaagtgcttgagcagatcgtgcggatttcacttgtcgcagtctgcacgacggtgtttctgccgtacgggattgaatatgccgcagcaggagccatgatttcgtctgtcatcggggagcttgcctctcttatttatttattcatttgttttaaagcaaataaaacaatcagaatcagaaaacaatttttcaagtcgattgcaaatggaaaagaaaccttccgccagctgatgagcgtgtcgctcccgacaaccggaagccgcttcatcggaaatttatcttggttttttgaacctattgtcgtcgcgcagagccttgcgattgcaggagtggccaccgctgccgccaccagccagtacggggagctgaccggatttgccatgacggttttgacgctgcccagctttataacctattctctgtcaacggcgcttgttcctgcgatcagtgaaggaatggagcaaaaaaagctgcaagttgtagaataccgtctggaacaggcgatgaggctgtgtcttttaagcggaggcatttcggtggttattttattctctttcgctgatgaactgatgtccgtcatgtacggatcaactaatgcggcggtatttgttaaagtgatggcgccgttttttctgctttactattttcaggggcctcttcaggcggtgctgcaggctctcaatttagccggggccgccatgatgaacagttttatcggcgccgctgtcaaaaccggcctaatttttgttttggcgaccaggccttccttaggcatcatgggcgccgcacttgcgattgtaacggggatggtccttgtcaccctgctgcatgcggccaccgtaagcaaggtgcttccgatcagcattaaaataaaagaatacgcgctctgttttgccgtcatattcatttgcggttatgtcagccgcatcatcaagcacaccgttcatttttcaggatcagaggctgttaatctcacaggctggattgcaatgaccgcgattttgtacattgcgctgctgctgttattcaggctgattaaaagggaagagctgatccggattccggtcatcggcaagttcgtgacgcggtgaagccgatttatggctcccctttttcatctttgagatcaataaaaaaagcgccgtccgtaaacgtgcagaatgatataaccgaaagatcgcgatatcctctttttgctaaatttttttcaagccagtgtttatctttcccgattctgtccagatgctcgttctgaatgaccccgtcaacgataagcgatgtttccatctgcttatccttattgtttttctttttgacgattgacagtttgcccgaagactccaaaatggcatacgatacgtcagagattctatcgatgttattctccctcagctgcataagaagatcgtcaaaattgtagcgctgcgatctcatcgcccgttcatcaatttttccctgttttataataatggtgggttttccgtcaagcagctgccgtattttttggcttttgagcgaaataaaagcaaggcttacttgaataatcattaaaacgacaatcggcacaattgtatgcaaaagcttatcttttacattttcaattgccaatacggcaatctcggcaatcataatggagacgacaaggtctaaaatgctcagttctccgatttcccgttttcccatcagtctgaaaatcacaagaatgataaaataaagcacaatcgtacgaaacgtaataatgaaaatatcttccatatcgcacctccaacggtcatagcatttgccatcggctctgaattatgtaagaaacgggctgaacatcatgcatttacgtctaattcgaacattcagagaatacatttagaaaaagacgggctccggcttgtcatatatcaggccgcagagcggagaggagataaaaatggaagaaacgaaacaagtgggaagaggcgttttgtacggcttagtggctatttttgcggtgatgcttcttacgagtttggcgatttcgcttttactgacagtcacctcaatggaagaatcatctttcagctggctgatcaccgcgctttcttttctttctttatttgcgggaggttttatatcgggcggcaaagcgaaggaaaaaggctggatgatcggagcgttaaccgccgtctgtttttcattaatcatcttgctttttcaatatttagggttcggaaaaacgtttacatccggtcagcttttgtttcatctcggctttttgggagtcagtatgctgggcggcattttcggagtgaatttgaaaggaagcagatcagcgtaataaaaaaagagcggattctccgctctttttttgtatgtatgagcttcgctgttattcagcggaagcttctctgattgcgcggcggtcaaatgttaaacgggtgttatcacctgttttaatgacgaccttgctttcatcaattgaatcaacagtgccgtgcaatcctccgattgtcaccactgaatccccttttttcagctcttcctgcatctggcggacggccttctgctgcttttgctgcggacggatgagcaggaaataaagcactgcaaacattaaaataataggaacgattgtgcctaaagtacccatctgtttccctcctttcatgaatggttttatttagaagcttttcgcatttggcttattatagccgtaacgctcaaagaactcttctcggaaatcaccaagacgatcctcccggatggcttgtctgacctgctccattaagtgtaacagaaaatgaaggttatggtaagttgttaatcgaattccaaacgtttcattacagcggatcaaatgtctgatgtaagcgcgggagtaattttggcatgtatggcagctgcactcttcgtcaatcggacggaaatcacgctcatatttggcgtttttcatattcagacgcccttcattcgtaaacaccgtgccgtttcgggcaatccgggtcggcagtacgcagtcaaacatatccacgccgcggatggcgccgtcaattaaggcatccggtgaacccacacccattaaatatctcggcttgtccttcggtaaaagcggggttgtaaactcaagcactcggttcatgacgtgcttcggctcgccgacagataatccgcctatggcataccccggaaaatcaagcgaaaccaagtcttttgcactttgtgtccgcaggtcttcgtattctccgccctgtacgattccgaacagcccctgctcatctgagcgcccgtgcgcctccaggcagcgttccgcccagcggctggtccgttccacagagcgtttcatgtaatcatactctgccggatacggcggacactcatcaaacgccatcatgatatcagagccgagggcgttttgaatttccatcgctttttccggagataaaaacagcttgtctccgtttaagtgattgcggaaatgaacgccttcttcttctatattacgaaacttgctcaatgaaaagacctgaaaaccgccggaatctgttaaaatcgcgcggtcccagttcataaacttatgaagcccgcccgcttcttttacaatgtcgtgtcccgggcggagccataaatggtacgtattgcttaaaataatgcccgcatccatagatttcagctcatccggagacatcgtctttaccgtagcaagcgtgccgaccggcataaatacaggcgtctcaaaggagccgtggggcgtatgaactctgcccagccgcgctcccgtttgtttgcattcctttataaattcataacgtatcggttgttcagccactttgtatgaggcctcctgtcttcaaattagataatcagcatggcgtcgccaaagctgaagaaacggtattcctcttctaccgcatgacggtaggcggaaagaacatgctctctgccggcaagcgcagaaacgagcatgataagggaagatttcggcagatgaaaattggtgatcatgccgtcaatcgctataaattcatatcccggataaatgaatatggacgtccagccgcttgaagcggtaaatacgccgtcatgctcgccggcaatggtttccagggtgcgcgttgatgtcgtcccgaccgacacgatgcgccctcccgcctttctgacctcgtttaaagaggcggcggtttcttccgtcatttcataaaattccgcgtgcatgttatgctcttccacatcatccgcactgaccgggcggaatgtgccgagtcccacatgaagtgtgataaattcaatccgcacacccttttgcttcagctcgtccagaatctcttccgtaaaatgaagtccggccgtcggagctgcggcagatccgatttcttttgaaaagacggtctgataccgttctttatcatcaagctgctctttaatataaggaggcagcggcatttcaccgagtgattcaagcacttcgtaaaaaatcccgtcataccggaattctatttttctgcctccgtgatcaagctcctccgtgcagaccgctgtcagccggccgtcgccaaatgtcaggaccgttcctttttttacgcgtttcgccggctttacgagcgtttcccatgtatcattttcttcctgttttaataacagaagctccactttcgctcccgtatcttcttttgtgccgaataatcttgcaggcagcacacgggtattgttcaagacgagacaatccccttcattaaaaaagcttacaatctctttaaatgaactgtccgtcagcccgcccgtctgtttgtcgagcaccatcagccgcgatgcgtcacgttctttcagcggcacttgggcaatgaggcgttcaggcagttcaaaatcaaataaatcgactttcatcatttcacctttattctgtctattgttatttcattctgccgaaaaaattaagcagaatggatagtatcacactgatcacaatacaagtgacaacgggaaagaaaaatgtaacatttcccttcttaacgaaaatatctccgggcagccttccgacaaagtgccagactgcgccggcaataagcaaaacggcaccgagaaccatgagaaccttcggaaagtcagtcacgggcgggcgcctccaatcgaaaatgttcatacacagccggagtcacgacccgtcccctcggcgtcctctggagaaatccgatctgcagcagatacggttcgtacacatcctctattgtatgcggttcttcgccgattgtcgcggaaatcgtatcaaggccgacgggacctccgctgaatttttcgatcatgcccatcagcagcttatggtcgatatggtcaaggccgagcgcatcgacttgaagacgttcgagcgcgtcgtgagcgatttcttccgtgatgcggctgtcgccgagcacctgggcaaaatctctcacccttctgagaagccggtttgcaacccgcggcgttccccttgaccgtctggcgatctccagagccggagcttcttcgatatccacttcaaaaacgtcagccgttcttgacacgatatctgtcagctcttcctgcgtatagtattcaagacgcgacagcaccccgaaccggtctctgagcggtgcggtcaataatccgacccttgtcgtcgctcctacaagcgtaaaagggggaaggtcgagacggacggagcgggcggacgggccttttccaatgacgatatcaaggcagaaatcctccatcgccgggtacagcacttcctcaatcgagcggttcagcctgtgaatttcgtctataaacagcacatcccctggttcgagcgccgtcaagatggctgccaaatctcccggtctttcgatggcgggacctgacgtcgtccgcatctccacccccatctcattggccacgatagacgcaagcgttgttttcccgagacccggaggcccgtataaaagaacgtggtccagcgtttcctgcctcattttcgccgcatcgataaacacgcgcagattttctttcaccttcttttggccgatatactgggcgagattctgcggcctgaggctttgctcgattattgattcatggctgtctgcttcacttgaaacgagccgttcatccatgaacatcaccttactttaataatttttgcaatgcttttttcacatattgatctgttgaaagcgccgtttcctcttttaagtgaggaagcacttttttaatttctttttcggcgtagccgagaaccctaagcgcttcaagcgcctcgtcaagcgccgtttcagcctcttgtttttcaatgcgcgcttcatgattgaacaggttgtcaatcatttcaggcacgacgtcggccagtttgcctttcaaatcaagaataatctgccgcgccgtttttttgcccacacccggaaatttcaccaaaaaggcttcatcttcctgttcgatcgcttcgatgacggctccggggtcaccggaaccgaggatggcgagcgcccctttcggcccgatgccggtgacgttcagcagctttgtgaaaagcgctttttcttcccgggttgaaaaaccgtacaaagaaaaggcgtcttcttttatatgatgatacgtaaaaatggtctcttgattgcttaccttataaataaacgggttcggagtgaagacctgatagccgattccgccgttttcaatcacgatgtattggggagatacataatcaatcgtccccttcacgaattcaatcacacctattcacctctttgactgcttatcattgtaacacaaaaacagccaaagtcttatagaaaagttaacgtatgttcgctttgacatcttccattcagaaaaaaaagacatgtgtcacatgtcttgcgtcaaagtcatccgctgtaagtcttaatatgatcgatcacgctctcaaactccgcttttgtcctgtacggtatgccgtgttccaagtgcttttgcaatcggctttccagcctttctatatcaatctggaagaaagattggatcggctcggccagcgatccgggacggccgtgaaaagtggagatgacgcctccgtccgtgacgccgatataaccgttaaccttactgagcggagaaatgtcatcaacatgcttacggaaaagaacgaagccttttttctgctcaacgagcgtccagcccgcatatgcggcccaaaaatcctccatcgccaaaacggtttcatccgtatgttcgatgccgacatcaccgtccagatagaccttttccagctggacgtgcacccgaagcggcccgtaatgctcaacctccgccccgtatgcgccttttcctccgcaaatcaggactgcagccgataagataagcataaacaatagacgagcaccgcaaattcgtttcaccaataacacctctttattcaatcaaactcttgatgctagtttgaccaaagatgccggtgcttaaccgttttctttcatttgtctgtttcagccgaataaaagcagcctctattatgaaggctgccccgatgattatgcccggccggctgaaatcagtttcatttgtccggacgtcagtttgagccggtatccccttacggtcagatacacagttttttctccgcggcttttgtcatgctccgtttttttcattccggcccctccgttacgttttattacttttatgttaacaccgcaacataaagagcgttttaagaatatgtaaagaaatgatgaagctttatccataaaaatactgccggatgaaatcatccggcagtcccgtttaacggctgtttctgttcatgtcttgcagctttgtaaaagtagcgttgtcggtaaacacttgaattgtacggccgtccgcaaatcttttggccgcatgtttgacatgtttatcatcatttttcgtaaaaggatgatttgttctgacagcaatgacgactctcgtgtcagtcacgatgacctgactatcctgtacgccttttacttttttcacgcggtttgcaacttttgccgccagcctgatgttttcggcgttgtcatacccattataagacatagctgccggcggcgtattgacatttcggccgttatatgtgccgtccgtcgttaacggaaccccgtcattaggcgcatactggtcagacacgtttgtcgtattatgacggccgtttcggttttccatcatttcagaaacgggtccttgatggtccattccgtactggcgtctgccgttatcattatcattcgaataatatccgaccggacgtgttgactgattgtagcgtccgtcattcatggcattatttgctccgcatgccgttaagcttgccgtcacggctaaaacgcctgcgatcgtcatcagttttttacccaatggaaaaaccccccgtggattcatcgctgtttgagcgttttccgctcatgtttaggatgtgcggccgacggcgggtttaagcttgtcagttatgtccattcctcagttggacataaaaaaaggaacgacatacatcgtcccgaaacattaatcttcttcttcctccggccgtccgaatacttgatttggactcggctgattcggtgcggcattaggatttgctccgccgtaaggcataaaatatccggcgtttgcacccacattcggatacggctgcacaggcatatttgcgtgatggtgatgtgaaccgtggtgatgatggtggtggtgatgtgaatcatggcagccgcaatcatcatccttaaatttcccatcatgatgaggcgcgtttgcgtaatgagacgaatatccgccgtaatacggcatttgaccgtacggagcaccgccgaaaccggatgcagaaccatcataatgctctgcattttcatgggcctggttttcatattcaccgtaacccgcttgcggcccaaatcccggatgatggaatccgtgatgatggaatccgtacggtaacggcatcggcattaccggaaagcctccataacctcctccaaaaccgccgaaacctccgcctaccgggaagcacggatggcatagtcccgaacccggcagcatcggtgtcaccggaaccggacaaggacaaggcatgcacggcatcgggtaatgcataaaaggcggttcaacggccggcatattcggaaacgggacattcggaatgtttggcatgttcggcagatgataagcggcgttttcttcttccatctttccggcttcaggcgccttcggcatattcgggtaattcgcgttttccatgttgatcatttcctcctgttgtggaatgttattgtcatgctctttttctttcggctcgacaaaatgtgtcaccggttcctccggcttaggaggcgaccacggctgaaacagctgattggacggataatattggttcatatcagcttccggcagcacattttcatgcttttcagggattggcggcacatacggaattgacggcttcggttcttccggtatggtgtcttcaatgtccacaactgatttcggtttttctttggcatatggatgctcatgcttatgcgcagacgttccgaagccggccttgggttcttttctgaccggaacggcttctgaaggcacctttatcttcattccaggcataattaagtctggattgctaagctgatgattcagtttttttaactcttcaagatcaactccgtatttttcagctattttccagagcgaatcgcctttttgaacgatatgaattttcaacgttttcccctcctatgcacaaaacgtgaacggtacatttgtcattacaatacgtttcttcacactatatgccggtggactgggcatgatgataaaaaatttgggaaggaggggaaatttttatgattacgtatgactcagcattctgttcaaagcacgaagcgcttctgtccgaaccgcttccggaactttaatgacacccttcggctcgcctttttcaagctgctcaagcgaccacaataaatgcggcaggtcgattctgttcattgtcagacacggacacatatcgggattcaatgattcaatctgtttatccgggtgcgagtgaatgaggcgctgaacaagattcatttccgtgccgatcgcccacttgcttcccggttctgcctgttcaatcgtatcaataatatatttggtagacccgctgtcgtcactgagcgagaccacttcccgcgaacattccggatgaacgataatgcggatgccggaatcccgctgccgcagctgaaaaatattttccgctgtaaacttttcgtgtacggagcaatgtcctttccaaaggatgactttaatgttttccggatggtcagtaagcaatcggttctgccccgggtcccatacagccatttctgtcagcggaatgccgaggtcataggctgtatttctgcctaaatgctgatccggcaaaaataaaattctttctttttgtttaaaagcccatttcagcacactccgggcattcgaagaggtgacggtcgctccaccgtgccgaccgacgaatgctttaatttccgccgtcgagttaacatatgttaacggaatgatggtgttaccgtacagttcttgaagctcttgccatgctttgtccgtctgctgaatatctgccatatcagccatcgagcatccggcgcgcatgtcgggcaatatgacggtttggttatcatcagtcagcatatcagcggtttccgccataaaatgcacgccgcaaaacacaatatattccgcctctttatttttttctgccacttgagcaagctgcagggagtcacctgccgtatcggcgaattgtatcacttcgtctttttgatagtgatgccccggaatgaacaggcgctttccgaaatcccgtttaatggcggcgacacgcttttccatttctccggtgctcatgtctttataatggctcggcatcatttcggctgatgcagttaacacgtcaaaaatagacatcttaaaaatccccctgttccgcagcctcaacatccatgctgatgtcggcgctttttactgaatgagtcagaaatccgagtgaaatatattggacgcccgtccctttataagcgggcaatgtgtcgagcgttatgcctccggatgcttccgttttgatatggcccggtgtcatgcctgcaaaacgccggacggactcaggcggacagttgtcaaacataataatgtctgcgcccgcttctattgcctcgagcagctgctgttcggattcgatctcgacttccaccgcaagcatctgccctgccgtttctcttgcccgctccacggccgcctttatcgatccgcaggcggcaatatgattatctttaatcatgatgccgtcatataagccgaagcgatgattaaagccgcctccgacccgaacggcgtatttttccagcattctgagccccggtgtcgtttttctcgtatcacaaagcttaatggacggatcatcaagacgccttttagcctcgtccgtcattgtcgcaatgcctgacattctttgtatgagattcagaatgacccgctccccagtaagaagagctgccgcccggccttccatttcagcgagcacatctccttttttcatccgttctccgtcttttttcagagggcggatgcggatatcatcgtgtaaaagcttccatccttcacggataacgtcttctccggcaaacacgccgtctgtttttgcgatgatccgcgctttacattgctgatcagaaaaaatcgcttgtgacgtcgcatcacccgttccgatatcttcctgaaaaaaatgagtcagcatttgtttcagctgcagaatgtccatagttccccaatcctttcgttttttctgataaccgttccagatgttgaatgaatgatttgttttccgtgccaatctttctccgtcccgggaaaatcagtacgaaaatgagcgcctctgctttcttcccgaataagggctgaggtgacaacaagttgcgcagtcttccataggcaggatagctctgcttgttccattgtgatatccttcacatttatatgatgcacagatacgttgttaagccaggatgtcagcgcctgcaggttttctttttccctgacgatacccgctccggttgtcattttggcttgaagcacatgaatcgttgtgtccggcacttgtaagatgacatcagttttcttcggggtttttttatatcttccgtttaacggtgtttgaatgatatgttcagcacatcgttgcccgcttgccagcgcttccagcagtgagttgctcgcaaggcggttcgccccgtgcaagcctgtgcaggcggtctcgcctatggcgtacaaatcaggcacggacgttttcccccatgtatcggcttttactccgcccattaaaaaatgcattccgggtgctatggggatcccgctttcaagatcaacgccggctgtttgacaaatttctgttatggtcggaaaacgtttgttaaaatcggctattcggctgcaatttataaaaacaggattttctttcatcatttcttcataaatcgcccgtgaaaccacatcccggggcgccaaatcctcaagcgcgtgtctgccagccatgatcctgcgcccgaagcgatctgctaaatatccgccttctcctctcactgcttcagaaatcagaccgtaaacagtcccgtttttcacaaggagggtcgggtggaactgggtgaactccatatccgtgatctcagctcccgcgcggaaggcaagagcgatgccgtctcccgttatggcggaatcatttgtgtgatattggtacagactgccgcagccgcctgaagcaagcactacacaatccgctcttctgtaagaaacggcacctgaagcatcctttacggcaacgcctgcgcatcgcccgtgttcaatcagcagatcaacaaccgtctcgtgttcaatgatccgaatgccgtccctcagctgccgaaccagaaactcaaccagcatccgtccggtcgcatctcccccggcgtgcagaatcctccttttggaatgagcgccttccctgccgagacaaaacgttccgtccgacttcgtatcaaaagggaaaaggccttctatcagcctgtttatcatgctctgtccgctttgcagcaaatgccgcacggctgtcacgtcattgtgtccgcatcccgcatacagtgtatcgttcacatgggattctatcgagtcatcttttgcgtatgaaacagcaatcccgccttgagcataatacgaattgctgttcgttacgtttctctttgtgatgacggttacttggtatgacggaggaaatgaggaagcacaggcaagggccgccgtccccgtaccaatgacgataattgttttttcagacatacatcaccctcccattatatttacacctgtcttgacacctatatttacacaacgataaaataaactcaagctttttttaacataaacggataggagacgggctgtatgatttatcttgattacgcggcgggaacgcctttaagcaaagaagccgcgaaagtctttcagcatctcagcacagaggtatacggcaatgctagcagccttcatgacgccggaggaagagcggcggacgtgctggaatattgcagacattctgcaggaaaattgatcggcggagcggcagacggcattcactttacaagcggcggaacggaagcgaacatcttggccgtccaatcattgctgtacggtctgcccgatcataaaaaacattttattacgaccgcaatggaacaccactcgatccataatgccgcggcgtttttagctgaccggggaattgatgtcaccatcatatatcccgacgaaaacggccttataaccgaggacatactggcggctcatatccgtcctgacacggggctcgtttccatacagcacgccaattcagaaaccggcctcatccagcctgtgaatcgtctggccgcttttcttcaccagagaaacattttactgcattgcgattgtgttcaaagtttcggcaaactgccgattgatgcggatcaggcgggaatcgacgccctttccgtctccggtcataaagtatacggcccgaaaggcaccggggctgtttacattcggccgggtgtcagctggaatccggtttatccgcataccgtgcatgaaaacgggttcaggcccggtacggtgaatgtgccggccatcggcgcttttaccgctgctgcggagtatgcagtgaaacatatggaggaacaccgtgagcatgctgacaggctgaggaattatttgtatgaccaaattaggcgtcaaggcctccccatttcattttcagaggaagaaaccggcggtgaatgcctgccccacattgtcgggtgtttttttcactcctttgaaggacaatatattatgttagaatgtaatcgtaacgatatttgcatctcaaccgggagcgcatgttccgccggcagccacggcccttcttcagctatgaaggcgctgagaaaaaccgaacgggaagcgcggcagtttttccggatctcattcggaaacgaaacaacatgtgaacagctcgatatgctgatacatacatttacggcgctatgggagcaaaagaaaggagaatcagcaatttgacagaaggaacgaagcttactggggcgaaaagacgcgacatgctgcttcattggctgaaagaagccggctcgccattaacaggaggcgaattggccaaaaaagcaaatgtttcaagacaggtgatcgtgcaggacatatcgctcttgaaagcaaaaagcgaaccgattatcgcgacgagccaaggctatttatacatcagcatgaatgccggcggcgaaaaaaacgccgaacggattgtcgcctgtctgcacggcccggagcggacggaagaagagcttgaactcattgtcgatgaaggcgtcaccataaaggacgtcattattgaacaccccgtatacggcgatttaaccgccgccataagagtcagcacacggaaagaagtcaaacaattcatggatcacattaactcgacaaatgccgcttacctttcacagctgaccggaggcgtgcatctccatacgttaagcgccccgacaaaagagcggattgaccaagcctgtcaagcgctggacgacgcgggtattttaataaaagattaaaaaaaaagccccctgaaggggagctttttttatatcgaataggattgatatgttcccagaagcttgacccggcagccgagggcttccatctcttgaacggcaccgggaatgagaacctgatccatcgcctgttcaatatcaataataaagaaatagttgccgagacccgttttggtcgggcgcgattcgatctttgataaattcaggtttctccatgaaaaagcggacagcaccctgtgcagcgcgcctgattggtcatcttggggaagcgttaccatcatcgtcgttttcggccgtgaagacagtttcgcattcacttcgaatgagacgtctttttcaggcgaaagaatgacaaatctcgtgtggttgtcctgataatcctgaatatcccgcttcacgatgctcaatccgtatgtagcggccgccatttcatttgcaatcacgccgatcggaaggtccgaatgctcactgacatacttggcagccgcacctgttgacttcgcatactcataaggaacggacgaaaaatgccggtgaagaaatttgtgacattgcgcaatcgcatgggaatgagaataaattttctcaagctttttccactcattttctctcgaagggtgaacgagcagatgctggtgaatcggcagcgtcatttcccccacgatcgcaagaggctgctcatgaatcaagtagtcaatcgttaagttaaccgagccctccagcgcgttttccaaaggaacaaatgcaagatcaacttctcccgcaaccgccgcatccatgcatgccggtattgtttgataaggtgcttgtgtcacgctgttttgaaagcaggaactgactgctagatgtgtaaatgtggcttctggccctaaataaccgactttcatgtctcttctctccttacgcgcctgaccctaagatctcaactttttctataaaatcaaattttctcagtttattcattaacgtatgaatgttttcttccattgcggacgtactgattgagagcgtgacattcgccctgccctgaagcggaatcgtctggtgaatggaaagcacgttgcttcctgagtcagccaccgcctgcaaaagctgggataacgcgcctgaccgatcctccaaatgaaagaaaagtgtgattatttgttctttaaccatcgtgtaaaaagggaaaaccgcatctcggtatttgtaaaaagcgcttctgcttaaatcaactttctgcacggcatctgcaaccgattcagccttttttctgtcgagcagctttttgacttcaagggttttccgcatcgcatcaggcagaacgtcttcacgcactaaataaaatgtctcttctttcacctgcacccctcccttttacatcagagagcctgcattgcaagctctccgtctttttaatcaataaattcaaattcaaattccagcagccggatgatatcgccgtctttagcaccgcgttctctgagcgcttcatcaacgcccataccgcgcatctgtcttgcaaaacgcttgacggattcgtcacgggagaagtcagtcattttaaagagacgttccagactgtcacctgaaagcacaaacgcgccgtccggatcacgggtaatgtcaaatggaatttcttcatcttccatcgtgtacattacacggttttccgccagttcttcttcatcatacagcgggaattcaggcgttgtttccagctggttggcgacttcaaacagaagatcgcggagtccttctctcgtcaccgcgctgatcgggaagacaggatggtcatcctgaagcttttctttaaacgcttttagattttcagccgcttcgggcatgtccattttattcgcaacgataatttgcggacgctccgtcagccgcagattatattcactgagctcctgattaatggtcacataatcctcatacggatcacggccttccatcgctgacatgtcaatgacgtgaacgatgacgcgcgtccgttcgatatggcggagaaattggtggcctaagccgactccttcgtgcgctccttcaatcaaaccgggcagatccgccatgacgaagcttcttccgtcatccgtttccaccatgcccagattcggaacaagcgtcgtaaaatgataatcggcgattttcggctttgctgatgaaacgacagacagaagcgtagattttccgacgctcgggaagccgacgagacctacgtctgcaagcactttcagttcaagcacgatatagcgctcttttccgggctctccgtgttctgacagctgcggcgccgggttggccggggtcgcaaagcgggtatttccgcgtccgccgcgtccgccttttgcgatgacggcgcgctgcccgtgctctgtcagatcggcaatgacctgttttgtatcgtcatccgttacgactgtgccgggcggaactttaacaaccatatcgtccgcatttctgccgtgctggtttttagacatgccgtgctcgccgcgtatcgctttgaaatggcgctggtaccggaagtccatgagcgtgcgcagtccttcatcaacctcaaaaacgacgtcgcctccattacctccgtcaccgccggcaggcccgcctttcggcacatatttttcacggcggaacgcaaccattccgttaccgccgtcgccgccttttacatatactttcacctgatctacaaacataatatcctccgttctaaaccgtaaaaaaccgctagttcattccaatttcggccacacattcatggccggtcagctcaaattgcatgacatcaaagtcctcataccgggatttgcgaaattcatcaaacacatctgcatttgcaatcgttccatgaaaatcgagatatacaataagctgtctgtcagggtgatccgtctgcagcgatacggtcagatgattttcactttcattgcttaccgccagaccgaacagatgaaacagttttctcatcaggttcgacagcttttgatcatatgccgataaatctttaatttctccgagcacttcgtattcgagcctcatataacgggacttccaattaaatgtcagaaagtcaaacgccaagtgcggggttttcaggtttgagagctttgactcgtgctttgcatctatgaccatttcgtcgattatttcaacgaccctgtcatacttctgcaaacttaagtttccttttatcagctgcagcttattcatccaatcatgacggaaatggcccattaattggatcagttcattgatcagagccgcatcgcttacaggttcttcttgtttcttcgatacatccttcattttcgcactcccaatcgtttaatttctttttaggagtcttgataagtgtgtactatgaattataacagagaaggctttgttaaaaaaacacttgtttttcctggttcatcatgttcctttttcggatcgcatacaatgcggatgccaggcagaaacatttttggtatcactgcttggggaacatatccagtgggtatgagaagctgatgtcctcattcaaggcggggttcactcacgcatcctctgcttttcattcttgatgttactccgcttactgcaaaaaaaactccagtcaacgaccggagttttttgtgtcattattgagctacaggatatacgctcacttttttgcggtcacggccgaaacgttcgaatttaacagttccgtcgattttagcaaaaagagtgtcatctcctccgcggcccacgttttcacctgggtagattttcgttccgcgttgacggtaaaggatagatccgcctgttacgaattgaccgtctgcacgtttagcgcctaaacgtttagattcagagtcacgtccgttctttgtagaacctacaccttttttagaagcgaaaaactgaagatctaatctaagcatgtaactcacctcctatatttggtttgcagtcaaccgtaagtgttcactgtaatcccgctcgatcgtttcaagagaaacaatcatgccttcaatcagcagctgcgctttttgcaaagcttcctgatcagcggcttcagggaattcaaaatagaaataacccccgtcctcgcctatatcaagaatcggttcgagaggagccagcgcgataaccgcattgaccgctccgaaaacgacagccgtgaccccggcgcaaacgagatctcgtccatgttcagcaaaatcggcatgtcccgtcatttcaaaggacaaaatgcccccgtcattccgggatcttcgaattgttgcctcaatcatgcttacgcgttgattttttcgattgtcaatttagtataaggctgacgatgaccttgttttttatgaacatttttctttggcttgtaacggaaaacagtgatttttttcgcacggccttgtttttcaactttagctgtaactgtcgcgcctgcaactgttgggttgccgactttcacgctgtctccgccaacaaacaatacgtcttcaaacgtcactgtttcacctgcttcagcagcaagtttttcgatgtaaacagtttgaccttcttcaactttgatttgttttccgcctgttttaatgattgcgtacattctctgcacctcctattagactaagactcgccagcaacaggggctttaaagctcttatcacctgtcccgagcggttgtagcattggtgctacatccataacattaaaaaatatatcagaaccaaaaggatatgtcaatctatttctagtaaggcagcagcaggtcttccatagaggaatctgtccgtttatcggcaaaatacgcatgaagcacttcattttcatcgagctggctgagcttttcgccggctttttcaatgataatggggtgcttgcatccccgtttgaattcagccatgacatgctttactttggcatcggccgcgaccgtcaaaggatgcagcatggcgacatcgcggtttttgccgtagtatctctccaaaagaaacctcagctgaatataatgccgcttccggtattcatcccataaagaagcggcgagaaagacgaacagcacccatgcgctgacctgaagggggacggccagcacaatccagcagcagagcaaaagcgcggaaacggccgatgtctgcaggctgaggagatgcgctttttgaaaagccatttgtttagagaagtataaaaacacgaacttgccgccgtcaagcggccagatcggcaaaagattgatgaaaagaatggagaggttataaaaggtaaacatctcaaatgtctgctcacttgcaaaacctgacgtgaaaaagagccaggctgccgcctgaagccacacatgctgaagcgggcccgccaaaatgaccgcgaattcctctttaagcggccggtttccgtgctcctccacctcaaccgtcccgccgaaagggagcagaaagatgcgtttaatgcgccacgaaaaaaacacagccagagcagcatgccccagctcatgaacggatacgaccagcaaaagacacagcagcgctttgatgtgccccgtcataagaccgagccccatgataatccaaagaaaaggatggacatgaattttaaaaaggaggatgagccatttattcatcaaatgtgatcacctggatcggatctatgaatttatcgccatcctggatcgcgaaatagtactggcctttacttttatcgttgagcttgatcgaaccgatctttttccctttatcgacaaaatcgtacaatgaaacgttaacatctttcagccggccgtaaatgctgcttgtattgtcggcgtgctgcaccttcaccgtcagccctgtttttttatctttgctcacttccataatgtagccttcttttacgctgtcaatggcttcactggcggtttcgacgacgacgccctctccgttattttgaaagtcctgctggattttccccgcggcaggaacggccatatcctgactgaccgccacctgaccgtccttctttttcgttcccggcgtaagaaaagcgagcgggtttccgaaggaagatacgaaccaattgcttacggcagcaaactgaaattctttttgaaaggtttgtgcgattgccggtttgatctgactcagcggctgtttgtcagttttataggcaatagcggagatcagtacgagacaggcggccagcaggcattttaaaataatagaatgagcgctgatcaatggatgccgcccgttaaattcgggcgggtgttccgtttgatattcgtagtccggaagaagcttgtgcttttcctgctccttgaccgtctgccacgcgggaaaattctgcgtttgagcgttttgaacgaaagtccgttttgattcaggccgctgttttcttcttttggccagtctttttctaatttcatcagctctgtgactcatcgccatcatcctttgcaatcgttgggtttgtacatcctatgtcttgtccattgcaaatatgcgctcttaaaaaacaaaaaagacctgataagctgggcttcatcagatctttgtattctggtatatattatgaacgcacgccgaaaaatgacttgattttcgccatcatccctttttgctgctcttcaagcacctgcaaaggaacggattctcctaaaatgcgccgggcgatattgcggtacgcaatgctggcgcggtttttggaattcatggcaatcggttcgccgatatttgaagccctgatcacttcatcatcgtcagcaacgattccgaggagatcaatagacagatgatgaacaacctcatccacatccatcgtgtcaccgtttttcaccaggtgatttctgatacggttcacgataaggcgcggcggttcgatatcttcctgctccaaaagtccgataatgcggtcagcgtcccgcaccgctgatatttccggcgtcgtcacaacaatcgccttatcagctccggagacggcatttttatagccttgttcaattcccgccggacaatcaataatgacataatcaaattcctgcttaagctcctgcacaagcgatttgatctgctcagggacaacagccgtcttgtcgcttgtctgggcagccggcattaaatgaagcagatcatcaaaacgtttgtctttgacaagcgcctgatgcgtcttgcatcggccttcaattacatctactaagtcgtaaataattctgttttcaagacccattacgacatcaaggttgcgcagtccgatatctgtgtctaccaaacagacgcgcttccctaaaatggctaaggcggtaccgaggtttgcagatgttgttgttttacctactccgccttttcccgaagttattacgatagcctcacccaatttcacattcctccctcaagccttgttagatcaggtcttaaatgagccaattgctgaaggcgttcaatgaccatatttccgtcagtatctaaataagcacattccatgtcgttccctttttgaatgtggtctggggagcgatttaacacgtgattgatcctcaattgtgtcggcatcatttcggatgcggcgatcacagcccggttatttccgttataacccgcgtgggcaatcccttttaatgaaccgagaacaaatatatttcctccggctctgatcgtaccgccgggattcacatctccgattaaaagcaaatctcccgtcacgtgaagcacctggcccgaacggacgattttggaaaccgaaacaatttcctgctcctctttcatccgctgcgcttcttctttggcgatgacttcactgtcaattgaatgcacgactaaatctttctttgacgcgatcagatcagtcagctgctctgcctgttcctgatacagataccgatgcccgagtttaatatgaacactgattttttggcctttgccatcagtatattgttcaatcgacagcatgttttgaagaccatcgaggagctcatcaaaagaacacgcatcatccagatgcaatgttaagccgttttttgttccttttattgttacatattgctgctttttggtcttcatcaatgttcacctcaacaacatactcttttcgtcaaaaaaagataaaatcctttttactcatctcttaattctttcttcagacttatataaaacagcctgaagggcaggactaatataacggctcccgcgatattcagcaaagcggtcggcaagaatcgctgaatgacaaaatcgttaaacgtcatagtgccgctgcggattaacgtctgaatgccgtagacgtaaaattcaagcacacatacgctcagcaccgcgaccagaatgaccatcagggcgtttgtctgcagcactttaaacgctttggccgccagatagcataatccggcaaaaccaaacatataaacgcctaaaacacccgtataattgatgtcataaagaaatccgaaaatgaaaccgtagatcaccgcatgcttttggttgatataagccgacataaaaatcagcgcaagcaaaagaaaatgcggaacgacctgctgctcgacggaaacgaaaggaaaacgcaccagatcggtatagatgctttccgcacaaaagaccaaaatcataatcaaagggagaaggaaacgtttcacgatccttcctcccctgttgctacgcttcggttcacgacgatgacatggtcaagatcgtacaagtcggcagccggtttcacataagcgattttcgtcaggccgtaagcatctgattctacatcggtcacttcgccgaccgtcagcccttgaggaaatacgccgcccgttccggaggtctccacgaggtcgccttttttcacttcacgtttttcatccggttcaaggatggtcattttcagggtctgtttctttttatcatacccttcaattaaaccgtagcctttgcttccctttttgccggagattttggtggccactctgttattgcggtcaacatcgctcagcagctgaacggcggatgtgaaactgttgagtccgctgcttttgatcttcccgaccagcgcacccttttcgttcgtgacagccatgtctttggccactttgtgcttcgttcccttattgatcatgatctgcttgtaccattgatcagggtttctggcgataacggtcgctaaaatcggatcatagtcggaaattgatttgacatgcccgagttcatcacgcagcttcttgttttcatctttgagttcttggagcttcgcttcatattgtgtctgtccgtccagcttttgtcttaagcgttcgttttctttgtacgtgtttttcaggtcttttatgtccccgaagaaccctgcaaaatattcggcaggcgtgtgaaaaatgttttgaaatactcccgtcgtatcaccgatcagcttttcaggccaggtggtattacggccgttcttcagcgagaatccaatcatagccaccaatatgataatacacagaagtaatagcattaaccgtttgttcggcatcgtgatacacctcttctatttaactcctgattatcttgtttttcctttgaaaagatggatgtgctccagtgcttttccagtgccgatcgcaacacaatccagcggatcttcagcgataagaacaggcattttcgtttcgtcgctgatgactttgtcgagattgcggagcagggcgcctccccctgttaatacaatacctctgtccataatgtcagcggccagctcaggcggtgttttttcaagcgtgctcttcaccgcatcaacgattgagagaactgtatcacgcagtgcatttgcaatttccgttcccgtgatttcgatcgttttcggcagacctgtcagaagatcgcggcctcggatttccattgacgcattttcttcaccggtttctgctgaaccgatttccattttaatggcttccgccgtacggtcaccgatcatcagattatatgtttttctgatatagctgatgattgagtcgtccatttcgtcaccggctacgcggattgactgagacgtgacaatgccgcctaaagaaatgatcgccacttcagttgttccgccgccgatatcaacgaccatgctgcccgtcggctcccataccggaagattcgcaccgattgctgccgcaaacggttcttcaatcggataagcgtcacgtgcgcccgcttgtcttgtcgcgtcgatgaccgcccgttcttcaacggccgtaatacctgacggcacacacaccataacgtacggctttctcgcaaacaatcctttatttttcacagcctgattaatgtagtatttcatcattgtcgcagttgtttcatagtcagcgataacgccgtctttcatcggacggagcgcaaccacgttgcccggagttcttccgatcatgtttttcgcatcgttaccgaccgcaacgattgacttcgtatccgtttgcagagcaacgacagacggctctctcactacgattcctttacctttaacaaacacaagcgtattcgcggttcccaaatctataccaaggtctcttgtaccaattccgaacatatgtatgtatcttcctttcttaaagcaaaaataccctaaagggaaaaactcataaaatctattatatcttaaatcaacgaaaaaaaaagtgttacaaatatcctttttcctttaaactcacaaattttttatcaccaatgaccaaatgatccagcagctcgatgccgattaaatttccgcactcaaaaagccgcctggttacctctatatcttccctgctcggtgtaggatctcctgaaggatgattatgaacgcaaatgaaggacgcggcggatcgtttgaaagcttctttaaacacctcccgcgggtggacaatagatgaattcagacttccgataaaaacggtgcgtttatgaatgacttgatttttggtatttaaatataaacagacaaaatgctcctgggttaaaaagcgcatatcctccatcacatacttcgccccgtcttccggagagcggatgacgcaatgctccccggcggatgtcttatgaatgcggctccccagctcaattgcggcaagaatctgaacggccttcaccgttccgattcccggaatgctggaaagctcctgggcagaggcgccttttaacaggcgcagcccgtcaaacgtccgcagcagccggtgagcgaggttcatgacggactcatgtttcgttcccgtccgcagcaggatggcgagcaattcattgttagagagatgttcggctccgaagtgcagaagccgctctctcggtttttctttttcggggaaatctcttaattttaacggcagatcacggatgatcaacccctccttgttccccttcccggtttgaacatcaagcttttatattaaattctttcaaggctctcattgttttagcgacaggaagcccgacgacagaataaaaatcaccgtctatttttttcactaaaagcgcgccttttccttggatgccgtatgcacctgctttatccatcggttcttttgtttcaatgtagagctgtatgtcgtcttcactgagcggccaaaacgtcacttccgttgtgtcacagaatgtttctttccggtcacgcgtctgaatgctgaccgccgtaatgacttgatggcttcggccggaaagcctccgcagcatctgtgccgcttcttccctgtcacgcggtttgccgaggcactcgccgtctatgcacaccatcgtgtcagccccgataacgactgcatcgggattttcggccaatacagcactagctttttgctcggccaaacattggacgttttcttccggcgaaaggtttcgatttaatttttcttctgtgcggctcgcaataatgctgtaaggaatctgaagaagattaaggagttcttttcttcgcggagattgtgatgcgagtattaagcgttttgtcatggttgtcatcctttcagggtttgcttaagaaaaaaagatacttgtctatcctaccaaatcaaacgggcaaccacaatttcagaaaaataactttttgatgacaaaataaaaaatcccgccggatgacgggaaatgagatactattttacaacacttaatagctctttttgggctttccagccggattccgaacccgacgtttccagttctttcagcgcttgaagcacggcctctttctgctttttgtcagcggcgtctgcgccgtctgccgcttttgccgcttcagccacttccgtttttgaaagatttttgccggtaatcgctttggcggagagctcagatgcctgtttaaaagagtcttccagccctgaatcgaccgcaaagctgagctcttttccgccccaagcctcaaaatcatggtctatcagtgtctgacccaattgctgtgataagcttttttccgctgcaagcccggcgatcacgtatgtgtatccgtcttcttttgccagagagacggccgagtatcctttttcagtcagctggtcaacaagcgtttgcgctcctttttctgatgaaaattttccggcctgcaccgcatatgttttatagtttcccgctgaagattccgcatctcctgtgccggctgtttcagatttgtcgttagaaacatctcccgctttcaccgtctgcccttgtgaacctttgtcagctgatgccggagcggaggcttctttacttcccgacatatttaaggcgacaaggccgagcccggtgcctaaaacagccgcaacggcaattgtcgtgaccgcttttttaactggagaagacggctgcttttttttcggaaaatgagggcctgtttttttcttctggtatggcggaacgactttcgggtcatcttcaaatacctcagaattcttctcatgatcccaattgaaatcttcttctttcggatcttcatgggaagcggcggtctcctgttccgccttttttgtttcttcccaattggaaaatgtgacggtcttctccccgccttcattcacatcttcttgtccatacatcgtttcttcttgtccgttaatggttactttaagggcattgtttttagctttgctgtgctttttgctcttcctttttttcaacgtctcttcccccttgcattcgtcttggccgtaccttgaactgatcatggttcacactttagcataggcgaaaaaaaaaagaacaagacttttgtcgtcttgtccaaaaaacgttcgccaaatttttcaagccccgcctgaagcgagcttgatgtaaaacgaaaacagctcatcaccgtataaataactcaaagcgctcccggctgagatggccggcgcaaacggaaatggctgctttttaccaagactgccccgggctgcagcgcacataccgtataccgctccgatcataacggaaagaaagaatgcaatgagcacgagcttcacgccgagcgtcaggccgatcaccccaaacagtttcacatcacctgcgccgatgcctcctttactgacaaacatgataaaaacaagcagaaaaaatccgcaaacggctccggcaaaccctgcataccatgaatccagcggagaaaacattcggccggcgatgaaaagcggaagaaaaaacagcagaactttgtcaggaatcagcatatattgcagatccgtcatagtaacaatcatgaggagagacagaaataacagcgcgactaacagttcttttgagaaaccgaaatgaatgcctgcagccgtgaataaacacgccgtccagcattccgccgccggatacataaccgacagcttcgcacggcagtttctgcatctgcctctttgcagaatataggagacgacgggcacaagctccccccaggagagcggcaagcggcaaaacgaacaggatgaacgcggcgaaataaccgagattcgcagcgggatacggcacgctgctgtataaaaaaaagaaccgaaaatcaagccgagaaaaaacagaattaaaagcactcagaccacacctttactatcaatctggctcagattatagcaaagaaaaacaccatgactgaaatggctgaaaatatattttcagcataaaaacacccggcaaaaccggaaaatggtctgccgggcatccgagaggctgtcagataagccgctttctcatctctgaaataaaatataaggagccggtaatgatgatgacatcatccgccccgtctttttgttctatccattctttcacactgtccgggttctcatcgaagctcttagatgcaagactgcttgcattgtaaagggcttcggcgcttgaagcacgcggaaagtcaaatgatacaaagtgaatggaatccgcttcggtttcaagctttttaatcatttcctgatacggtttgtcttttaatgcgctgaatacgacatggacgtttttaccggcaaagcgctgccggatcgtttctgtcagcgtttcaacaccctcttcgttatgggcgccgtccgcaaacactaaagggcggctttgaagacgttcaaaccggcccggccaggaagattttcccagtccgtttcgcatcgcttcttctgaaatgactgcggcctccaggcgattcagccattcagcggccaatatcgccaatgccgcattctgcctttggtgaatgccgatcagcgacgtttgaatgttttcatagcatttcgtttctgtttccagcgaaaagctttcgccggacggaagcgccgcttcattaaacagtctgcacgttttatatagtgactgatacggagcctgctttttttcggcttccgcttcaataacgccgagtgcttccggctgattgacgcccgtaatgaccggaatggaatttttaataataccggctttctgcccggcgatctcctcgatggtattgcctaaaatggccatatggtcatgtccgatacttgtaatgaccgacagaagcggtttcacaatattggttgaatcaaatgtgccgccgagccccgcttcaaaaatgacaaaatcgatatcagcccgcttcgcaaaatataaaaatgcacacgctgtaatgatttcaaattccgtcaccgttccggcatcggtcttatcaagctcatcgactatcggttttatgtcattaacgagcgttctccattcctcatcggtaatcggcgtgccgttgacgctgattcgctcattaaacgtaatcatgtaaggcgatgtgaacgtgccgaccgtataaccggcttcttgaaggacggaacggataaaagaaacggttgatcctttgccgtttgtgcccgccacatgaatggcgcgaatgttcttttccgggtgttccagtttttccatcagcttttccatacggagaaggcccggcttaacgccgaacttgagtctgccgtgaatccagctgatcgcttctttgtacgtattaaacaatgaaatcccctcttttatacgacaaggcggtttcttaggaaaccgccccgctgttttatcagcctttcagctctgcaatccgctgccggacagcttcgcgttttgccgtgtagtctttctcttttccgcgttcttcttcaatgacatgctcaggagcttttttaatgaatccttcgttgccgagttttttctgaacgcgttcgacttcttttgtcagcttgtcgaattctttttgcagacgggcgatctcctcatcaatgttaatcagcccttcaagcggcagaatgacttccgctccggtgacgacagctgtcatcgctttgtctgccgcagcgatatccgtcccgattttcagcgtgctcggattcgtaaagcgttcaacgtaagaacggttcttctcaaggcggccggcaatgtcttcggtagatgttttaatgtaaagttcaacctgcttgctcatcggcgtgttgacttcgctccggatattgcggacagaacggattaattcaacgagcagtttcatatccgccgctgcctctttatccgtatgttccggcaccggaaccggccaagagctgatcgtgattgactcgccttcatgaggaaggtgctgccagatttcttccgttaagaatggcataaacgggtgaagaagacgcatcgtctggtcaagcacgtatgccagaacagaccgggttgttttcttcgccgcttcatcttccccgtacagcggaagcttcgccatttcgatataccagtcgcacacatcgtcccagataaagttgtacaggtggcgtccgacttcaccgaattcataacgatccgcaagctgtgtcacgtcttctatcgtttcattcagtcttgtgaggatccacttatcagcaactgatttttcaccggacagatcaagctcgtcatacgtcatgccgtccatgttcattaatgcaaaacgggaggcgttccaaattttatttgcgaagttccatgtggattccactttttcatagctgaaacggagatcctgtcccggtgaacttccggttgccaggaagtagcgcagggaatccgctccgtacttgtcgatgacatccatcgggtccacgccgttcccaagggatttactcatttttctgccctgctcgtcacggattaagccgtgaatcagcacgtctttgaacggacgctcgccggtaaactcaagaccttggaaaatcatccgggatacccagaagaaaatgatgtcatatcccgttacaagtacatcggttgagtaataccgcttaaagtcttcagcgttttcatcaggccagcccattgtagaaaacggccaaagcgcggagctgaaccatgtatcaagcacgtctgaatcctgctcccaattttcgctgtcctcaggcgcctcaaggccgacgtacacttcttttgtttctttatgataccaagccgggatgcggtggccccaccacagctgacgggaaatacaccaatcacggatgttttccatccagtgcaggtacgttttctcgaaacggtcaggaacgaagtgaaccttctcttcttttgcctgaaggtcaaccgcagcatcggccagcggctgcattttgacaaaccattgtgtggacaggtacggctcaacaacggcgccgcttctctcactgtggccgacagaatgcatatggtcttcgattttaaagagaacgccggattcctgaagatctttgacgagttttttacggcattcaaaccggtccatgccgttatattgcagcgctttttcattcattgttccgtcttcattcatgacgagaatccgctctaaattgtggcggtttccgagttcaaagtcattcgggtcatgggcaggcgtgattttaacggcgcctgatccgaattccatatcaacataatcatcgccgacaatcggaatttcacggtttgtaatcggcagaatcaccgttttgccgattaagtgcttgtagcgctcatcttcaggatgaaccgcgacagccgtgtcgccaagcatcgtttccggacgggtggtcgcgatttcaattgagcctgaaccgtctgctaacgggtagcgcaaatgataaaacgcgccctgtacgtctttgtaaatcacttcaatatcggataaagccgtttttgtggcagggtcccagttgatgatatattcgcctctgtaaatcaagcctttctcgtacaacttgacgaatacttcacgcacggctttgttcagcccttcatcaagagtgaaacgttcacgtgaataatcgagtccgagtcccatcttggcccattggctgcggatgaaatcagcatactcttctttccacttccacgtttcttctaaaaacttttcacggccgaggtcataacggcttgtgccctgttcgcggagtttcgcttcgacttttgcctgagtggcgatgccggcgtggtccatgcccggaagccagagcacgtcatagccctgcatgcgtttcatacgcgtaacgatatcttgcagcgtcgtatcccacgcatgtccgaggtgcagcctgcccgtcacgttcggcggcggaatgacgacagaatacggctgtttcgtttgatcgccgcccgcttcaaaatattttcctttcagccaaaaatcatagcggcctttttcaatcgcagacggatcatattttgtcggcattgtttgttcgtttgtatccatgataaccctccagcatgtttagaaatggctgagcaactaaaaaagagccttcatcctgataaaggacgaaaagctctttcgcggtaccaccttttttcatgaacagatttgttcatgcacttaaacggataacgggtgcggcccgaatttctctactgtatgttcaagaaattatgctcccgggcgaccttccaatgagacggcataagaagcctttcagcacagtagcttctctctcttcatgcgtctttcttgtactcttcccgttcaaagcaggtgtatttatatcagctcatgatcttatttattatgttctttattatagtaaaagtgtttttgattcgtcaatcatcttttccaaaaaccgctgccgtcatacataaatgggcatgcaccccgctcttccccttacatacgatacatagaaaggcgaatgtgaggaggaattgcccgtgagaaaaaaattcaattcttattcgctcccccagtgggccagacaggtccgccttgtatccgtgcaagtcattattccgattacgatctttcaggggatcaggacgattttctttccgacgacttttgatgtcctgctgcttgccatcctgctgtttttagcgtgcgccctgcatttggaatggatataaaaaaacgagtcctgttatgaagaggactcgttttccgcttttatttttttctcccgctcaatctgatgaaccttcatgagaaaaggctcaacatttttcatctgccaaaacgctcttaataattgcgtgcactcttctttttcagagcccctttggccggtctgataccgtttcagcactttgtacatggcggacggataagccatatagctgagaaacagactgatttccgcttcacggagcgggaatgatttgtgatacgtataaaaccagtccagacattccggacatgctttcggatagcttctgaacattctggagtaaaagccgagcaggtcattttgcggagggcccagcgcagctttctcgaaattcgtgaaaaagcccgatcccgcatcattatacagaaagtggcggctcgataaactgccgtggttgatcaccgctctcgtcttgtcatgatcctttgccgcgtcaaaccattcttccagacgttccagagcaaaattgacggcggaaaccgtttctgtaagatacgtaacggcctgcagttcaaaaggtgaaaggtaccactctttttccgcccggtcggcgaattgttcatagacaagcttatcattttcccaatctcttttcgttgcttcataaaagccgctgatatcttcagtccggatttggatgtcccgcacagtcgcagaatggagcttcgcgacctctttaaaaaggtaaacatgtttttgatcccgttcttcctcctgatcgtactgaagccaaggcattaaataataagaattctccgtctgtctccccgcaaaaaaatcgccggcatacgtgcggcagatcggcacaaatgatcggtagcctttctcctcaatctcaatcataagatccgtaaattcactgctgcgggccggcttgagctgtttcaaagcaaaaatgccgtagtttgagtagaccttccaaacatgcgggctgacaggctcaatatactcagccgccagcccgtattcctgaagcactgattggactgcttccattccattcaccacatttttacggcctctttgtgcttacacatggctgttattatattcaggtatatacagaagctgaccttcctcaagctcgtcatcaaacgataaagcattcgttcggatgagctgctgggatgtaatgtcatatcgttcacacacccggtcgattgtatcttgctgctgcacgatacaaattttcattcttgaaaacttttcttcttcccttgtaaataattttgtcaagtaatgagagttgtcattttccttctgctcggttcccggtgccgcttcttcattctttctttcaggcttaagcggctcaggctgttcagcttgcgccggctcctcaggcggcagtttggaaaactgaaaagacaaatcgagaggcttcccggtttcctcctccggcggcgccatcttccttacctcaatttcaaacccttcttcaccatgagcctcttcttcaagcagcttaggagcgctgtaaaactcctcttcctgccgttccggaacgaactcgcgataaacgggcgcctgctcctcttgaaaaaccgcaggctcatcttcgtcttctgccgccttatgatcgctctgacggagaagcggctcggcctctggctgctcttctttttgaaggaagggctgttccgcaatttttggtttttctgcatgcggagtcagagtgaaagcagggaaaaccggttcgatatcatctttcggctcttcctgcacttctgctgaatcatcctcaaatacgggttcattcctcacagctgacatgattgcaggctcctcagcttcttccggctcttcttcgtgctggaaggaaacgggaggaggaggctcagtaaaggaaacaggtttaggcacctcttcttgctccctcagaatcggggctgcttcctgctcttcttcttcttgctccctcaaaaccggggctgcttcctgctcttcttcttcccgctccctcaaaatcggagctgcttcctgcgcttcttcctgctccctcagaatcggggctgtttcctgcttttcttcttcccgctccctcagaatcgggcctgcttcctgctcttcttcttcccgctccctcagaatcggagctgcttcctgctcttcttcctgctctctcagaagcggggctgcttcctgctcttcttcctgctccctcagaagcggggctgcttcctgctcttcttcctgctctctcagaatcggggctgtttcctgctcttcttcctgctccctcagaatcggggctgtttcctgcttttcttcttcccgctccctcagaatcggggctgtttcctgctcttcttcctcctgcctgagtaaaggcgggatttcttcctcgttcttctctgtttcttgtgctgcttcttctgatacagtcaaaggtatttcaggctcatggcgtatcattaattctggttcattttcgtcctcagaatgatgtccggcaagattgatcatttcttctctggaaaattcaggcgccacgtacaaagggatctccggctctttcggctcggattcctcaagcagcccttcaattgccaaatcagcttgaatggttaagatccttgaatccgtcagctgataatcaaaggcatcaataaatacgaaaacatcattgaggtggctcactttatttttcggaatcgtgatgtccaccgggaaacaatgaatgagctcggccgtgccatcctccctcgccctcacttcctctacatgcctcagctccctatcaagctcttcaaaatgactgctgtgatctatgttgtactcgccagtaagttctaatgatcctttaattgagacataatcatttacttcctgcaccctgatgtcagggtctaatgaaatcgaaagtaattcagaaacttcctgtcctttttggaaacagattgattcttcaacagaaaattgcaatcggtgattatgcggcaagttcatatcctcctttcatctaatccatacaattagatgtcactaaaggtgtatgccgcaatccgggaaaatatgataatggaggcattgaaaaaagccgatacaagtcttgcttgcatcggcttttcggtatcagcggctgatcgcctggaacactttctcagcggcttgaatggtattttcaatatcctccattgtatgcgcagtggagagaaacaatccttcaaattgagacggcggcagaaatacgcctgcgtcggccatccctttataatacttggcgaacagctttaaatcagaagatttggctgcttcatagttaatgacaggctcattggtgaaaaagaagccgatcattgaccccgcccggttaaacgtgtgcggaatgccgtgtgctgcagctgcttttgaaatgccttcttcaagcatatcgccttttttcacaaattcttggtaagattcaggtgtgagctgctgtaacgtctcaagtcccgctgtcatggcaagcggatttccagacaatgttcccgcctggtagatcggaccgctcggcgcgattcgttccataatgtcagcttttccgccatacgcaccgacaggaagaccgccgccgatgactttgccgagacacgttaagtcaggcgtcacgccgaaatacccttgcgcgcagttataatccacgcgaaaaccggtcatgacctcatcaaaaatgagcagcgcgccatactgttccgtaatgtcgcgaagtccttgtaaaaagccttcctgcggcggaacaacgcccatattgcctgctaccggttcaacaatgaccccggcaatatcttcaccgtactcccggaatgcgagtgcaacgctttccaagtcgttgtatggaacggtaatcgtattcattgctattccttccggcacgcccgggctgtccggcaggccgagtgtcgccactccggatcccgctttgatcagcagcgaatcaccatggccgtggtaacagccttcaaatttcaaaattttgttgcggccggtgtatcctcttgccagacgcagggcgctcattgtcgcctctgtgccggagctgaccatccgcacgatttcaacagacggtacacggtcaatgaccaatttggccagttcgttttccacttcagtagatgccccgaaacttgtcccgttctcggctacttttttcaggctttcaacgaccctgtcgttcgtgtggcccaaaatgagcggcccccagctcagcacatagtcgatatattcattgccgtcaatatcaaaaattttcgatcctttgccgcgctgcataaagatcgggtccatatcaactgatttaaacgcgcgcaccgggctgttcactccgcccggcatcagtttctgcgcttctttaaaagcggcttttgatttttcatagcttctcatctgcctcagctcccgtcaaatgaaatcgttactcagcaagccatttcgctgcgtcttttgcatgatacgtcataatcagatcggctcctgcacgtttcatgcccgttaaaatttccagcaccatttctttttctttaatccagccgttttgggctgccgctttcaccatggaatactccccgctcacattatatgcgaccagcggcaggtgatggcggtttttcacatcacgcataatatctaagtatgacatagacggtttgacgattaaaaagtcagcgccttctgccgcgtctgattcagcctcacgtagcgcttccaggcggttggccggatccatctggtatgtttttcggtcaccgaactgcggcgtgctgtcagccgcgtcgcggaacgggccgtagaattcacttgaatatttcacggcataagacatgatcggaatattcgtgaatccttctttgtcgagcgcttccctgatcactgtgacaaaaccgtccatcatatttgaaggagcgatgatgtcagcgccggctttagcctggctgacggctgtctgcgccagcagctcaagcgactcgtcattgaggattactccgtctttcacgaccccgcaatggccgtgatccgtgtattcacagagacatgtatcagcgatgacgatcatttcaggataatgctttttaatttcagcaatccctttctgcacaatgccatgatcgtgaaaagcctgggttccgcaggcgtctttttcttccggcacaccgaaaacgatgaccgacttaatgccgagcgatatcagctcagccatttcatcctttaacaaatcgagtgatacatgataaacccccggcatggaaggaacttctttttttccttcgagtccttcaacgacaaataacgggtaaataaaatctgaagggtgaagacgtgtttcttttactagatctctcatcgcagcgttcgcgcgcaaacggcggtgtctgttaaatgtttgattcatcattatctatcctttcccgacatgctgcacatgacgtccagcatgccttcaatcgtataggtgtcaggcacatgggatgagatcccgtattccaagagcgctttctctgtcaaagggccgatgctgatatagctcgcaccgctgttttcccacgctttttctccgtctccgaccgcgtgcataaacgtatgcaccgccgatgaactggtaaacgtaataaaatcaaaatgagagcgggatgcagcccgtctcagctcgtccatgcctttttcatcctgaatggtattgtataacacccattcccttatttgatagccaagcggctcaagctccgcttttatgacatcgcgtgataaattgccctttatcaatgaaacgggttcggcagctgatgcgtgccgttttaaagtatcagccagacattccgccacatactcgtcaggcatcgcatccgtccgggctccccgctctttcagggcgcgcgctgtcttttcaccgacggctgcgatttttttccgttccggaagcgcaaggccatgctgatcaaggtaggaaaaaaagaaccggacaccgtttacgcttgtaaacacaagccagcccggttcagaaaggtcttcccgcagactgtccgcacattcatccgggagcgcttcctgaaaagcgatcagagaggcggaaacagccgttccgccgagcgcctccactttttttcgaaacggtgctgcctgtcttttgttccgggtgacgagcacggtctttccttgtaaaggaaggtcatttgccatcctgttcgagctcctgtttcacgctgtcgattagtgctttggctcctttttcagacatcatcgccgcacagcgtttcccgatttcttccggatcatgtcccgccgctgtttctttataaatcgtctttccgtccggagacgcgacaagaccgaccaattcaacctcatcccggtcattgacggacgcatacccggctatcggcacttggcagccgccttccatcgcgtgtaagaaagcccgttcggctgccaccgtgcgctgcgtatactcatcggtaaattgcgcaaacagcttcaaaagctcttcatccgactctctgcattcaatggcaagagcgccttggccgaccgcaggcagacagcggtccggttcgaggaattccgatacgacatcatctttccagcccattctcgaaagccccgcagccgctaaaataatagcatcgtaatcttccgtttcaagcttttgaagtctcgtatcgatattgcctctgatccacttaattgtaaggtcagggcgttcagcaagaatctgggcgcttcttcttaaactgctggtgccgatgatgcccccttcttttatgccgtccagcttttgatgcccttttgaaatgagcgcatcacgcggatcctcacgtttcggtatgcagcctatgacaagaccctcaggcaaaacggcgggcatgtctttcatgctgtgaaccgccatatcaatctcctgatgcagcagcgcctgttcaatctctttgacaaacaaacctttgccgcccacttttgacagtgtaacatcgaggatgcggtcgccttttgtgacaatctcccggatttcaaagtcataggaaggattcaattccttcagtttgttaatcacccattttgtctgggtcatagccagtttgctccgtctggaacctaccttaatcgttctcattttctttcctcccgaatctgtttgggcgcgtgcgttaactgaaccaatggaattgtgacaggcttccgagcaggaagtaattaatcatcagcacgagaaaacatgctgaattccataacgccgccactttcccctgcagttccttaatcattctgatatataaatagtagctgtataaaagcagcacaataaacgagccgagcacttttgagtcaaaccagtacagcgtttccagcgacacatacgcccagatcacgcctaatatcaggctcaacagcagcatcggaaccccgatgacatttaaaacgtaagccatataatcaagttttgacaaatcttcaattctcaacagccattttccccattttttcttctttaataaagaatattgaaactgataaagaagcgaaaagacaaaagaaagggaaaaagcgccgtaagacagaatcgccattgtaatatgaatgaccaaaagctctgagaccagctggccggaaaaggcggccgaatgctgatccgtcggtgaaaacgtatggatcgcaatcatcgagaaaccgatgacattcgtgaaaaacacgataaaatcaacccgcagaatctgcgtgaccacaagtgaaagcgtgacaagcacccacgcataaaagtaaagggcctctgtaatattcaagaccggaaatctgcccgtctgccacatgaaataagaaagatagacagtttgcagagtccagacaatagaaagcaaccagaaggctatttttccagccttccggttgtgttgaagaaaatctataaagtaaaaaaggacgcttactgcataaataacaattgtcgcttcattaagtcttgccattgctgtatcaatcatacagccctcactcacttacaagcggacgtaagcccgtttttgcttctgccttttgaaacgaatgaaccgtctggcggttatccaggcttttgtccagctggcggccggcctcttcctcaatatcgaaaatctgcataaacagcttcagcttttcatctgaatccgcttcagccgcaagctctttcgctttcagaatcgggtcgcgcagcatttggttaatgatgcttttcgtatgtttgctgagaagttttttctctctcaccgtcagatgaggcagcttgcgctcaatgctctgcatcgtatcggactggatggacagcgccttttcacgcagcgccgaaatgaccggcacgacgccgagcgtattaagccactgcttaaactcaacaattgccgcttcaataaacagctcgactttttcagcggtttcgcggcgttcttgtaagttggcttcaacgattccttcaaggtcatcaatatcgtacagaaaaacaccttcaagatcgttaagcgccggatcgaggtctctcggcacagcgatatccaccataaataacggacggcctttccgctgtctgcccgctctctccatcatttctttagacacgacgaaatcactcgcgcctgtcgaactgattaaaatatcagcttcagcaagtgcatattcaagctggtttaagctgcgcgcttctccggagaaacggtcagcaagcgcttttgccttcaaaaacgttctgttgatgaccgttactttgccgataccctgaccgtgcaggttttctgcggcgagctcgcccatttttcccgcaccgagaatcaaaatgtgcttatttgacaatgagccgaagatttttttcgcgagttcaacggcggcgtaactgacggaaacggcattggagccgatatcggtttcggcatgcgtgcgtttgccgacggtcaccgcctgtttaaacagctcattgaaaatggtgccgatcgtcttttctgcctgcgccgttttaaagctcgagcgtacctggccgagtatttgcgtctctccgatgaccatggaatctaaaccgcacgccacacggaataaatgctcgatcgccgcgtcgctctcataaaatttcagaaacggagacagctcttctttcggcagcgagaaccattcggataaaaatgtctttatataataacggccggtatgaagctggtcgaccaccgcatatatttcggtgcggttgcaggttgacacgataatgttttctagaacgcttttttcttcttttaagcggagcatcgcttctgcaagctcatccggctgaaaacttattttttcgcgtatttcaataggggcggatttataatctactcccacaacaagaatatgcatcgctttcatgcacccccgtacatcgcaatttatttataatcattctaacatagaatttattatttataataattataacatagtttcttcgggaaaatgtgaacagatttcaaaaatgttatgctatagtataaaaagctcgttcccactgtaatcatcatactaaaaatcctttactgcgggtaggtgacaggatgaaaaaaacatcaattttattaccgggacttctgcttgccgcttcattatttgcatggcttcagagcggacaggttcacctgtttgcgaatcaggggaatggccggtgctccttatgctcttgggggctgtgctcttgtatcagggcaaaaaggaagcggccgggcctcacgtcctgatcggcatgcttcttttcggcataggtttacactttttcgccaaacctgagctctcatggtggccgggagattttgaaatgattctcttcgtcttcggattctccttatttgcggctgccagaaaagaatatgtatacgaagcggctgccatgattggtttttccctctttttatacttctttaaacaaattacggcgtggctggagtccgtccatattccgacggaacacttcaaaacatactggccgtatgttttcatcggaatcagccttttattattgtttatcaagcggaacaaaactatacgataaaacccaaaacgcactgcgttttgggtttttcattaccggctgatcatttttttaatggctccccatgcttcatctttgccttttttcgtttcagaggaaaataaaatcagctcatcttcaggatccatatcaagcgtctgtttgacaacctttaagtgcttgtcccattttccttttggaatcttatccgcttttgtcgcaatgacgatgacgggaatgccgtaatacttcaggaattcatacatgttcacgtcttcagcagacggcgcgtgtctgaggtcgacaatctgcacgcaggctttcagctcttcgcgggtcgtcatataggtttcaatcattctcccccatgcttcccgctcgcttttggaaactttcgcaaatccgtacccgggaacgtcgacaaaatgcaattcatcattgatgatgtaaaagtttaaagtctgtgttttccccggttttgatgacgttctggccaagtttttccgattgattaatgaattgataaaagatgactttcctacatttgatctgcccgccagcgcgatttccggaagccccccatcagggtactgttcgggtttgaccgcgctgatcacgatttctgactttgtgactttcatttcttctctcctactaaggcatgttccaaaacgtcatccaggtgagaaacgaatataaacttcagtccttctctgacgctttctggaatatcctctatatctttttcgttatctttaggcgcaataatagtggtcaggcccgctctgtgcgcgccgagcgccttttctttcagtccgccgatcggaagcacgcgcccccgcagcgtgatttctcccgtcataccgacttcgcgttttaccgcacggtccgttaatgctgaaacgagcgccgtggccatcgtaattccggcagaagggccgtctttcggcaccgctccttcagggacatggatatgaatgtcatacttctcatggaatttcgggtcgattccgaactgttccgctttcgaacggacataactgaaagcggcctgcgctgattcccgcatgacatctccaagcttccctgtcagaaccagctttccttttcccggtgacaatgacacttcgattgacagcgtatctccgccgaccgtcgtatacgcgagccccgtgacaaccccgatttgatcttcggtttccgcctgtccgtatctgaatatccgttttccgagatagtcggccagatttttctctgtaacggtaatgcgttttctctcctcagacacaatggctttcgcagcctttcggcaaatggcggcaatctggcgttcaagcgttctcacgccggcttccctcgtgtagtagcggatgatgtccgtaatcgcctgatcccgaatctgcaggttgctctttgtgagcccgtgctctttgatttgtttcggcagcaggtgatctttcacgatctccagcttttcgttttcagtgtagcctgacaggctgataatctccattctgtctctgagagggccagggatggaagcaaggttattcgcagtcgcgataaacagtactttcgataaatcgaacgtctcttcaatatagtggtcgctgaatgtgctgttttgttccggatccagcacctcaagcatcgccgaagacggatcgcctctgaaatcagacgacattttgtcgatctcgtcgaggagaaagaccggattttgtttgccggcttttttcatcccctgtataatacggcccggcatcgccccgacgtatgtgcgccggtgcccgcggatttcagactcatcgcgcactccgcccagtgaaattctcacaaaagtgcgccccatgctcttactgattgattttgcaagagatgttttaccgactcccggaggtccggccagacaaagaatcggccctttcagcgttttcgtcagctgtttcacggccaaatactccaaaatccgctctttcactttctctaagccgtgatgctctttatctaagatttccccggcttttttaatatcaagtttatcttctgtttcatccgaccacggaagggcgatgagccagtcaatatagttgcggataacagagctttccgctgagcttgacggcactttttcgtaacggcttaattccttaagcgccgtttctttgacacgctcaggcatgcctgcttcttctatcttttccgtgagcgactgaacttcgccggtttttccttctttgtcgccaagctccttctgaatggctttcatctgttcgcgcaaataatattccttttgagtgcgttccatcgaacgtttgacgcgctgaccgatttttttctcaatctccagcacttctttttcattatgaatggaacgaatgaccttattcagacgttctttaatatccgccgtttctagaatgtcctgcttgtcctttaatttcagcgggagatgagaagcgacgatatccgccattctgccgggctcttcaatatcagtcacagccgcatacgtttctgcggaaatttttttagaaatttttatgtactggtcaaaatggtccagcagcgtccgcataagcgcttcgtcttccacgtcttttgaatcatcctcatgcatcagctgtatatcgaccgaagtataatcttcgagttcggtgtattcaaggatctgcgcccgctgaattccttctacaagcactctgatcgtaccgttgggcagcttcagcatctgtttaatttttgtataagtgccgacggcgaaaatatcctcttcacccggttcgtctatcgaaatatcctgctgagtggctaaaaaaatcatatgatcatgcatcattgcctgttcaagagcctgaaccgacttgtcacggcctacatctaaatgtaaaaccattgtcgggtataccaataagcctcttaaagggaggagcgggatgctgcgttttgtatcttctgccatgtgactgacacctccgtgactttagtatgaaccattataatacaactttttcatcgttgtacaattccgggatcgggctttaatcggcttatccgcctgccctgtatataaaacagtctcttcgtagtataccctttctttctgttctgaaaaaggaaaagatgtcctccataaaaaaaccccattataaaaatggggtttatacggattctttattcatttggatatcaaacggtttttgttctgaaggagggtcaaccaatatgacgtcaagcacttcctggaacgtttttaccgctttaatggtgattccgtctattcgtttcagaatggactgctgattttcataagggataatgaccgtttttgctccggcctgttttgcggctttaattttcggaatgacgccgccgatcggtttgacaagccccgtcaggctgatttctcccgtcatcgccaccgtatggtcgatcgggatgcggtgaatcgcggaaaaaatccccgcggccatcgcgatacctgctgaaggtccgtcaatcgggcctccgcccggaaaattgacgtgaatgtcatagtctgaaggtttgatgcccattgtgcggagaaccgtcagcacattttccacagatcccttcgccatgcttttgcggcggatcgacttcgattggctgccgatgctttcttcctctgcaattcccgtgatattcaggcttcctttgtcctgcgcaggtgtgacattcacttcgatttccagcaatgcgccgctgttcggcccgtagacggcaagtccgttcacgatgccgacttgcggttcatcggcgattttctgctcatttttaggtgtgagctgactggaatgaacaacccattctatatcttcagtcgtgatttcttttctgtcctcagtcaccgccatgccggcagcgatctggatcatattgacggcttcacgtccgtttctcgtatatgcggtcagcacgctgagagcttcgtcagaaatctctttctgaattttgtcggctgcttttttcgcaacgattttaagttcatccttttccagctcgcggaaaaatacttcaagacagcgcgaacggatggccggaggaatttcagtcggcattctcgttgtcgctccgatcaaacggaaatccgccggaagcccattttgaaaaatatcatggatgtgattcggtatttgcgtattttcttcactgtaatacgcactgtctaaaaatacttttcggtcttcaagcaccttcagcattttattcatctgaatcgggtgaagctcgccgatttcatcaataaacaataccccgccgtgagcatgggtcacagccccctgtttcggctgcggaatgcctgcttggcccatcgcacccgctccctgataaatcggatcatgcactgaaccgataagcggatcggcaatcccccgttcatcaaatcgcgcggtcgtcgcatcaagttcaacaaaaacagcctgcttttgaaacggtgactgtttatgctttttcgcttcttccaataccaaccgcgccgcagccgttttaccgactcccggaggaccgtaaataatgacgtgctgcgggttcggtccgcaaagcgctgcttttaacgctttaattccgtcttcctggccgacaatgtcctgaaagcttttcggccgcaccttttctgataaaggttctgataaactgatggcgcgcattttgcgcagctgttccatttccttttttgattctttatctatcgtcactttttgtgttcgctggtttttgagcagattccaaaaatatagtccgatgactatcccgaaaaacagctgtacaaataatgcgatccctgtccaactcatgctggtccctcctgaaaaaacgatttatgtatccaattcattcctctgtccgctagtatctcccagcaaagcccggaataaacattttcagaagggtcaggacaagaaaaaaacctcctgattaattcgggtcaggaggttttgtcgtgttatgctgatgttttatcttggccgacaacagtaccgtcttttaatacaagacgcggcgcttcaccgtctgcgactgtcgctccggtaatgacacatttttcaatatcatcgcgggacggcagatcaaacatgacgtcaagcatgatgccttcaatgatagaacgcaggccgcgtgcgcctgttttacgctcgatcgcttttttcgcaatttcagataatgcctcgccttcaaattcaagctcgacatcatcaagttctaacattttcttgtattgtttgacgagtgcgtttttcggtttagtcagaatttcaaccagtgccgtttcgtcaagctgctcaaggcttgcaatgacaggaagacggccgatgaattcaggaatcagaccgaaacggagcaggtcttccggaagaactttagaaagcagttcttctttttccaggtctgccgctttattatcagagccgaagccgatgactttttgtccgagacggcgtttgatgatttgttcgatgccatcaaatgcaccgccgcaaatgaacagaatgttcgtcgtatcgatctggatgaattcctgatgaggatgtttgcgtcctccttgaggcggcacgcttgcaaccgttccttcaagaattttcagcagcgcctgctgaacgccttcgcctgatacatcgcgtgtaatggacgggttttcagattttcgcgctactttatcgatttcatcgatatagataatgcctttttctgctttttccacatcatagtctgctgcctgaatcagcttgaggaggatgttttctacgtcctcaccgacatatccggcttcagtcagagatgtagcgtccgcgatcgcaaacggaacgttcagaatacgcgcaagcgtctgggcaagaagtgttttcccgcttccagtcggtccgattaaagaaatattacttttagaaagctcaacatcatccactttactgttggaattgatgcgtttgtaatggttgtataccgcaaccgcaagtgatttcttcgcctgatcctgtccgatgacatattcattcagaatctcacggatttcctgcggcttcggaacgtctttaaattcgacttcttcttccgtaccaagctcttcctctacgatttctgtacagagctcaatacattcgtcgcatatatatacacccggtcctgcaaccagcttacgaacctgatcttgcgtttttccgcagaacgagcatttcaattgtcctttttcctcgttgaatttaaacattctttcaccccttaatcttgtctcactttttcttttacctgaagggcaaaagaaaacggttcttgctacgatcgagtatgtattgcattttaccatactttccagtaagacggtaacaatgtgtttcgcacttgcacattctatatgtatgacgaaaaacagcccggcaatgactatcttgccccaagaaaaagagttatatcataattgtacaaaacaaggcacgaattaatcgcgccctgttttattatgtctattattatgaaccatattaacggttttctacaagaaaatcaattgcttttcgaacttttaaatcttctttcatcgcgtcagttgaaccgattgcctgcttgatgttttcaaccggcatgttgtaagcttcagccattttagtcagctctgcttcaacttcttcgtccgttacttcaaggttttctgcttgagcgatcgcttcaagagtcaggtttgattttacgcgttttgcggcatcttctttcatttgctcttttaacgcgttttcgtcttggcctgagaattgagtgtaaagctcaaggttcatgccttgcatttgcagacgctgttcgaattctttcagcatgcggtcaagctcagtgtcgatcatcgcttgaggaacatcagcttcagcgttttcagatgctttcagaacaagctcttcacgcaatttagcgtcagcttcgttttcttttgcttcttcaaggcgtttttttgttttctcggttaattcagcaagcgtttcaacttcttcgtcaatgtcttttgcgaattcgtcgttaagctcaggaagctctttcgctttgatttcatgaattttcactttgaaaacagctggttttccggcaagctcttcagcgtggtactcttcagggaatgttacttcaacatccttttcagcgcctgcttcaaggcctgttaactgctcttcgaagcccgggatgaatgaacctgatcctacttcaagtgagtagttctcagcttttccgccttcaaacgcttcgccgtcaacgaaaccttcgaagtcaagaacgactgtatcgccgttttcaacagcgccttcttctttcacgacaagctcagcctgacgctcttgaagcgctttaagttcgttttgtacatcttcgtcagtaacggcagtgtcatctttttcgattcctaagcctttgtaatcgccaagtttcacttccggttttacagtcacttttgcagtgaaaattaagctttcgcctttttcgattttttcaacatcgatttcagggcggtctacaggctcaatgccggcttcttcaaccgctttagggtattctacaggaagtaaaatatctaaagcatcctggtaaagagcttcaacgccgaaacgctgttcgaataaaccgcggggaactttccctttgcggaatccaggaatagaaacctgttttactacttttttaaatgcatcatcaagagctgttttgaacgtatccgcatcaacttcaaccgttaatacgccttcgttgccttcttgtttttcccattttacagacatgtgtttccctccaaaaatctattcaggttgtgtcggtcttccattctaaagcaatccgcggctttgtcaaagaaaaaaccgctttgaatcagaatcattatgtaatgaactggcagcctgtccaaccgtaattctcatttcagttaaaccgctatacataaatacaaccactatattataacataacgcctaccgctttcaactatatggtgtgatttacaaataagaaatttcttcaatatccttaatcatcgtgcaggcttcttcgagttcgcggctgtcaaactcgtacatcatatgaagttcctccggctcaatgtcaatgccgtgcatctcgtaaccgaccttatgaagcgccgccgcccataaatccgcgttcaaaaacttcggcataaaagggtgcaggacgtacagatgtcttctccacagctcctcgacggcagcatataatgtagggttttcattgcccagcgtttcatcaagcacccggagaacgcgatgcaaaatcggagccgcatcaggctggaccgtttcactcggtatcgcggtcattgaatcgccgaattttgtaatatggaccggtttactgtagtcgtgctcggccatcagcgtcaaaatcattgtcttaataagaggatgcgcgcccggatcttgaagaatcgtttttaagagacccgtgtattttgcaatattgcggtctttaagagaatgaatcagattcatttgttcagcggggctgttcagcactttttccgtatcaagaatgtcctcgtattcctcctcccacgcctcctcctgctgatcgggatcggtcattttgcggctgaattcgagcagccggtagaattgctccgcactttctgcgggcagctggttttcttccagcacagcttcaattgtgcttttgacttcttcatattgtttcagctgaattaaaatggtcatgtacacctgcaatacggtgaaataatggccgtacccttcattcagcattttctcgcaaacttgttttgcttcttccaattccccgagttccagaaaacaaatcgccatgcctaaatgtacgtcggactcggtatcgccgtggcttaccgcctctgaaaacagttcgagggcctcctcatactgtttatccttcatggcggccatccctttatcaaccaagcgttctttcagacgggggaaaggaatgatatcagcttttttcttgtcatgcgtcatactttatttcctttcaggcgcttattttgttcaagtgtatcaacacgcgtcatgaaacacaagaaaggatgatgcacacggtaaaaaaagccgccggacagatgccgggcggcttttttcaggcttgaagccatgaacttcttttcgattcaaactgctgaatgtcgtcctccagcagaagcgttaatgaaatttcatcataaccgttaatcagcatttccttccagtgcggatcgacttcaaatgaaatctcttttccttcactgtcgtgaatgagctggttttccaaatcaaccgtcatatttagagactgattttcatattgaccggcgagttttttccactgatcatacggcatacggatgggaagcataccgtttttaaaacagttctgatgaaaaatatcggcaaatgacggagcaatgatgattttgaagccgtaatcatccagcgcccaaggagcgtgctcacgggatgatccgcagccgaaattctctccggcaattaatatggacgcgccttcatagactttgcggtttaattcaaattcaggatcaggctcaccgttctcaaggtatctccaatcaaaaaacgcgaatctgccgtatccggttctttcaattcttttcaaaaactgtttcggaataatctggtccgtatcgacgttgatccggtttaagacggccgcttttcccgtatgcgtttttaaaggttccatcttttcgcgcactccttacacaactgttttttcttgataaaactttcttacatcgacgaaatgcccgtgaatggccgccattgccgccatcgccggactgacaaggtgtgttctcgcgccttttccctgtctgccttcgaagttgcggttggaagtggaagcgcatcgttccccttcaggcacgacatcattgttcatactgaggcacatgctgcagcctgattccctccattcaaagccggcctcgagaaacacgcggtgcagcccttcttcctcggcctgctgtttcacgctttgagaacccggcaccacaatggctctgacgctgtcggcgacttttcggcctttgatcatatccgcagcctggcgaagatcggtcatccgtgaatttgtacaggagccgataaacacatgctcgactttaatatcttcaattttttgattcggcgcgatccccatgtattcgtaagcgcggatggcttcttttttaccgtcttcagaatcaatcgtttccggcgcaggtatttgggcatcgaccggaagaaccatgccgggattgacaccccatgttaccattggagaaatctcgctgccgtctaacacgatggaatgatcgtatacggcgcccggatcggtttttaacgctttccattctgcggcggctttttcaaattcctcgctttttggcgcgtatttacggtttttacagtattcaatcgtcgtgtcatcaggagcgatcagtcccgcacgggctcccgcttctattgacatattgcagacagtcatgcgttcgtccatagacatgtttctgaatacttccccggtgtattcaatgacatatccggtaccgaatttcaccccgtattttccgatgaccgacaagatgacatccttcgctgtcactcctttttggagcgttccgtcaacgcggatttcaagcgttttcggccgctgctgccataatgtctgtgtggaaagaacatgttccacctcacttgtgccgataccgaaggcaagcgctccgaacgcgccgtgagtcgatgtatggctgtctccgcaaacgatcgtttttcccggaagtgtcagaccaagctcaggcccgaccacatgaacgattccctggtctgcgctgtgaagatccgcaagacggacgccgaactcctcgcaattccgttcaagcgcggttacttggcgctttgcgacttcatctttaatgtcaaaacggttgacggtcggaatattgtggtccatcgtcgcgaacgtgttctgcggccgtctgacctttcttcccttctgccttaacccttcaaacgcctgaggagacgtcacctcatgaatgaggtgcagatcaatatagagaaggtcgggttttccttcaccgctttttacaacatgccgatcccaaatcttttcgatgattgttcgaggcatcatctttgtttcctccctctacctattgaactaagaccgctttctttaaagcgtcatactatagattttgtattcgagccggctaatgcggcttttactttttcagtaatgtcatgcgttccggcatattggccgtcccgggcgatatcacgtgtacggctgccgtctgcaagcacctttgcgaccgccttttccaccgcctgcgcttcgttttcaagtccgaaagatgttctcaaaagcatcgccgctgataaaatcgccgcaaacggattggccatccctttaccggcgatgtcaggcgcagatccatgcacgggttcaaacaagtgaagacctgaacttgataaactggctgacggcagcatgccgagcgagcctgtcagcatggaggcttcatcgcttaaaatatcgccgaacatattttcagttacgatgacgtcaaactggctcggagcgtagatgagctgcatcgcggcattatcgacaagcatatgttcaagcgtcacatcaggaaattcttttgcgatttcatctgccgtttcacgccacagtctgcttgaagaaagcacattcgccttatcaacggacgtcacttttccttttctgccggcagccatcttaaaggcttctctgacaacgcgtgcgatttcttctttcttataaaaaagggtatcgaccgcttccttttctcccgcttcattgacatactgtctgctcggttctccgaagtagaggccgcccgtcagttccctgacgattacaaagtcgacgccgctgatatattcttttttcagcggagacgcctcagacaggctttcaaatacggtcacaggacgcagattggcaaacaggccgagcttttttctgatgccgagcaggcctttttccggtctgagctccggagggttttggtcccatttcggcccgccgactgccccgagcaggatggcgtcggatctttcacaaagagccaccgtctcctcaggaagggggttttgatgggcgtcaatcgctgctcccccgatcagcccgttttcaaattcaaattcatgtccgaattgttcagcaacgcttttcaatacatctgccgctgattccgccacttccggtccgattccgtcacctggaagcaaagcaatgcgttttttcaaatcaaacgttctcctttctattacgagccgaccgcagtccgtctctttaatccgtctaaattgcaatccagcaccaactgccgattcacggcgttcagataagctttagcagaagcttccagaacatcctgcgcgattccccgccctgatgtttcttttccgttcacggtcactctgacataaacttgagccagcgcgtcttcgcctttccggttggattggatgcggtagtctgtcagttcaatatttttatcgatgcagcgcccgagcgtattataaacggcttctacgctgcccgcccccgttgccgcctcttgaatcagctgttcgttttcctgatttttcaaagagactgttgcagtcggcacctgagacgttccgtaatgcacttgcagagacagaaattcatagccgatttttttgtccgtcactttttcttctaaaataagagaaatcaagtcatcatcggtgatttcttttttcttttcggtcagttctttaaacatcgtaaaaaatttattgatttcctcactatcaaactggaatccaagcgcattcaggcggtctttgaacgcatggcgtccggaatgctttccgagtacgagcgcatcagcagtcacgccgacaagttccggtgaaatgatttcatatgttgatttttctttcaggaaaccgtcttggtgaatgccggattcatgtgcgaaagcgttatctccgacgattgctttgttgcggggaacggccatgcccgtcagtttgctgacaagatcactcgtccgcttcaattcatgaagattgagagatgaatcggcttgatgcgcgtcatttctgacatgaagcgcaacggcgatttcctctagcgcggcgttcccggctctttctcctatgccgttaatggcgcattcaatttgatcagcgccgttctcaattgccgaaagtgagttggcaaccgccattccgagatcatcgtggcaatgggcagagagctttacccggctgatattcggaacgtgttccttcatatatttaaagatgtttccgtattcagcaggcgtcaggtaacctacagtgtccggcaggttgatgacgctcgcgccggcatcaatcactttttctacgatttcagccagaaacggaagttcggtgcggcatgcgtcttctgccgaccattgaacgatcggaaagcgttcttttgcatacttcaccatttcaaccgctttttccttaacctcttcccgcgtcattttcagcttatgcttcagatgaatgtcagaggtggcgataaagatgtgaatgcgcgggctgaccccgtctttcagcgcttcccaggctgcgtcaatgtcacctttgacagatcgagcaagccctgttaccgaacaatttttaatcgttcttgcgatttcctgcacggctaaaaaatcacctcgggatgaagcgggaaatcccgcttcaataatgtccaccccgagtctttcaagctgcttggctatcgccagtttctcccgggaattgaggttgaccccgggagattgttcaccgtcacgaagggtcgtgtcgaaaacattaattttgcgcaacggagaccaccgcttccttctttttgccttgtttgacaaacggcatcatttcacgaagctgtctgccgaccttttcaatctgatgctcgttttcgcttgcattgatcgcattgaaacgaggacggttcacttggttttccacgatccattcttttgcgaatgtaccgttttgaatatccgttaatacttgtttcatcgattcttttaccttcgcatcgactacgcgcggtcctgatacaaagtctccccattgagccgtatcggaaatagagtatctcatgcccgccaatccttcttcatacatcaagtctacgatcagcttcagttcgtgcagacactcgaagtatgcgagttcaggctggtagccggcttctgtcagcgtttcaaaacccgctttgacaagcgccgttaaacctccgcacagaacagcctgctcaccgaacaaatccgtttccgtttcttccttaaatgttgtttcaagaacccccgcacgcgctccgccgattccttttgcataagcaagagccgtatctttcgcttcgcctgatacatcctggtagatggcaaacaatgccggtacgcccgcgccttgttcatatgttcttctgacaaggtgtccaggtcctttaggggcgacaaggaatacatccacatcagcaggaggcacgatctgatggaaatggacgttaaatccgtgtgcgaataccaatgacttgcccgccgtcaattcatctttgatttcagcttcatatactttttgctgctgctcatccggaagaagaaccataatgatatcagcctgggcagccgcttctcttaccgaaaagactttatgaccgtcttcttgggcctgtgtaaatgatttgccttgtctgacgccgacaatgacatcaattccgctttcttttaagttcagcgcgtgtgcatgaccttgtgaaccgtaaccgataatcgctacttttttacctgccaatacgttctctttgatatcaccgttataatatacttttaccattttaatctctcccttttttgtgttatacaattgaaattgttttattggatgacgccttctgctgggttcccctcgcaaaagccgttgtgcccgttctcgcgatttctttaattccgtaaggtttgagaagctctatgagcgcttcgattttattagattcgccggtaacctgaacgacgatgctgtctcttgagacatcaacgacggaagctctgaacggctcaatgattccattgatttccgttctggccgacggtgcggaaacaactttgattaatgccagctcacgctgtacaatcgattggtttgtaatatccgtcactttcaggacgtcaatttgtttgttaagctgctttgtcagctgctctacgtcattttcgccttccacatggacgacaaatgtaatccttgaaacaccgcttgtttccgtgtggcctacagtgatgctttcgatattatagtgtctttttgtaaacaggccggtgatccggtttaatacccccgagcggttgaccaccgttaatgtgataatgcgtttcaaggtttcacccccaccatttcatgaagtcctttacccggcgcgatcatcgggaatactttctcgcttttggcgacccggacgtcaataacggccggttcttttgatgaaagcgcctttttaagctcttcttccgcctcttcttccgatgaaatccgaacgcctttaatgccgtaggcttctgacaatttgacaaagtcaggctgcgccgagaatttggattcagaatagcgttcttcatagaagatttcctgccactgtctgaccatgcccagacattcgttgttcaagataaccactttgacaggaagattcagctgccggatgacatctaattcctgaagggtcatctgaaaaccgccgtctccgaggatggcaacgaccgtggcgttacgatcggccagctgcgctccgatggccgccggaaggccgaagcccattgtgccgagccccccgaggtcacccacttatcagcctttcggaaaggataaaactgagccgcccacatctggtgctggccgacatccgtcgccacaatcgcctcaccgtttgtgaattggtgaatatactcaatcagcttttggggtttcaagccctcttctctgtcgtctgtataccaaagcggatattcttctttccattctgaaagctgctgtttccattcctctgtctgtccctgttttccgttttgcttcaataattcctgaaggacgattttactgtcgccgaccaccggaatctgcgtttcgataatttttccgatttcagcaggatcaatatcgatatgcgctactttggccgattttgcaaaatgcttcagatttccggtcacgcgatcatcgaaccgcgctccgatgctgatcagcaagtcacagtggtaaagcgccatattcgctgtgtatgtgccgtgcatccccgccattcccagaaaaagaggatggtctgccgggaaaccgcccagaccgagaagcgtgtgcgctaccggaatttgctgctgttcggcataattttttaaatcttctgaagctttaccgtgcaaaacacccgctccggctaaaataaccggctttttcgcactgctgacagcttccacgagctttcggatctgcagatagttaggctcttttaccggctgataacccggaagattgatctcgtgatcatatctgaattctccttcaaatgctgcgacatccttcggtatatcaattaataccgggcccggtcttcccgtcgtggcaatatggaacgcctctttaatcacacgggggagatcttccggacggcggacttggtagctgtgtttcgtaatcggcatcgtaattcctaaaatgtcggcttcctggaaagcgtcgctgccgatgaccgaagtggcgacctgaccggtaaacactacgagcggcagtgaatcaatcatcgcatccgcaagaccggtaactaaatttgtcgctccgggtccggaggtagcaatcacaacccccggctttccggagactctcgcatacccttctgccgcatgaatcgcgccttgctcgtggcggggcaggatgtgaaccaatcctgattgatacagtttatcgtaaatcggaaggacggctccccccggatagccgaagatcatctcgacattttctttctttaatgattcaatcagcatcagagccccgttcattgtttttgtacaatcggcagacaaagaatccgcctgtacatttgtgcccattttcagttcctccttttcaatgttcccttctaaaatccaattcataaaacgcagcgccggctgacgcaaataaaaaagccttcccacccacattcagccaagcatttcatgcgatagccaaaaggggcgaaaaggctttgctctccgcggtaccacccttgtttacggtcatatgcagaccgtctcatggataatgattatccgttttgataacgagtaaacattgcgttcactcggccgagtcctactctttacatttcagaccggcactctgaggggagttcactttgatttgttttaccggctctcagcgttaccggctctctgtgaaaaacttcagcaaagctacttatcctcttctgcgctttttattatggcagctcttttattaaaaaagaaccttcatttgtttgttttttcagtgttttatgatttttctttttagtgtgaatcatttatttatttttgtttgaactcatattacgcccgtttgcagacagtgtcaacagcatttttataattattagacaatttagattaatcaatctattttgtatacgctttcattactgatataaaaggatcggcaaatgttaaaagtttttatattttttttattaatctctcaagattacatgaaatttttccgttcatatacgaatatgtcacattttattacgcgatttttctctgtccttccggcatgcttgtcagatattccgttcgattgaacaggctctttatacagacatacgcatacactgttcttatctcgtaagaaatgagtgatgtcatgaataagatgttatcaggcatgcagggcctgcctcctggatttccgcctttaccggtcttaccgccgcagtcttactatcctccggccccgatgcatacagcaccatatcaaggcggcccttcttttcagcagggatttccgccatccggatacggacagcagaccccgcaaagcacactgtcattcgccggacagcaattcgttccgtacccttatacatccgggtactacggccaaaccttcagtgacgtcggcggaagcctcggcgccggggcacatcccggcgcgctcggtggcggtttcagcggccatgccgggggcttcagcgctccgagcggattcagatgatacaaaaaccggtctcacacggccggtttcttttcttattcacagagtataacgttcattccactgattcatttcctgctccgtatagtaatcagcccttgaaacctcaacaatgattaaaccgcattgagtgattaaaaattgtttcagttcctcaaacagctcgtcttttccgcaaaagatcgtttctatattgtgatttttatatgcaaatgcgtacttcaaaagctaattcctcctgctgtctttctatcaatcatcaacaaaacgtatgatagaaatcagataatttatcactcaagggcgccttaagtatctttatacatatatttattacggtaaatattacattaagtttcatttacattaaaattactttacaattttcatcaaatacggaacttttgtttcgtaaaactaaaaataaaatacaaaaaaacctcaaacccattgtcagggcttgaggttttttatacgtcccaggagagattcgaactcccgaccgacggcttagaaggccgttgctctatccggctgagctactgggacatgaaaaacaaatatctgctgattattttaccatgatatcagtgaattgacaatatagtcatccgataaaaaaggccagcggcatcagttttcactctgatgtcaccagctctttttttgtacgtcccaggagagattcgaactcccgaccgacggcttagaaggccgttgctctatccagctgagctactgggacagcttttgctttatgtatcagcgacaagatttattatatacaggttcaaatcataagtcaatattttttaaaaaacttttgatggggaagaatgaaatctcccccatcacttgttaaaaactgattgtattccccaagtccttcaattcccgacccgtttcgtcgtaaaatgtcacggcgccttctctttctgtaagagtaagaatggcatagcttttcacattgcggactctcggaagacggatgctgcccggattaatcaaaagcttgccccgaagcacttcactccccgcaatatgtgaatggccgaagcagacgatatccgccccaagctcttccgcccggtaaaaaacagttaaaagtgactgtttaatgccgtgaagatgcccgtgaacggccagaattttctttgaaccggcatccagaaggagttcatcctgaaacccgccgccaaagtcgcaattgcctttcaccttgtgatacggcgtgagtgccggatgtgcggcgtcaagctctgaatcaccgcaatgaatcatcagatccgcttcgtcttcgtgccgctttgcaatcgtctccagctcgtcttcaaggccgtgactgtcacttattatcagcactttcattgcatacgctcccccttatgaatcaagcagctttgacagtttcttgagcgcctcagccctgtggctgattttgtttttctcagcgcttgtcagctgggccatggttttatctttatcttttacaataaaaatgggatcatagccgaacccgttatctccttcgggtccttctgcaatatacccttcaacatgaccttcgaccgtttttgtttcctgccccggcatgctgacggcaagggcgcagcggaaacgggccgtgcgctgctctttttcgatgccttttaattctgacagcaccttgtccatattcgccttatcatcttttgcttctccggcataacgggctgaataaacgcccggtctgcctccaaggttgtccactgataaaccggagtcgtctgcaatgaccattttgttgacggcttttgccacggcttccgcttttaagatggcgttttcttcaaaggtatgtccggtttcctcaatttcttccgtaaatccgatttccgccaaagaagagacgctgtagcctttcggttcgagtatttccttgaattctttcacttttccctgattgtgtgtcgcaataatgacttctttcacgctgatcaggcctctctttcttatttcagttcaggcaatgtttctcccagcacttctttttgcttttgaataagcgtctggattcctttttcggcaaggcttaacagtccgtttaaatcttcacgggagaatgtggcttcttcgcccgtcccttgaagctctacaaaacgtccgcttcccgtcatgatgatattcatgtcgacttcagccgccgaatcctcttcataattcagatccaaaagaaggccttcttctttatccatcccaacagaaatggccgcgagataatctgtcacgggagaggttttgataacgccgctttttacgagtttgccggtcgcaatggccattgccaagaatgcgccggtaatggaagccgttcttgttccgccgtcagcttgaatgacgtcacagtcgatccagatcgtccgttcgccgagcttctccaaatcaacgacggcccggagcgcgcgcccgatcagccgctgaatttccatcgttctgccggagacctttccttttgaagattctcttatcgttctttgattcgtcgcgcggggaagcatgctgtattccgctgtgatccagccttttcctccgccgcgtaaaaatggcggcacccggtcttccacagatgcattacagatgacctttgtatttcccgctgtaattaaaacagagccttccgggtgagtgataaaatccaaatcaaatgtgatagggcgcagctcatcgtgctgtcttccgtcgtgtctcatattttacctccgattatatgtacataaaccttttgttccggattgtgaataaagaaagaggcagccggaacgctaacctcttttttactagtatatcaaaaatcgcaaattaaaaactacccgtattcacttgtgccggcctcgaaacaggttttgaaagggattctcctttttcattcaccagttctgattttccgtttacttttatagaaacacttttaatcgacggctgttcggttaacgtgagaacgatgctgtccagtacgcccgatgacaccatttttgttttttcgtcggcgcttccgtaaatagagctgttaaagtccagtgtaacctggccgtctttcactttcggcttgctgagaagcttaacatcgttattaaagtccgtcaaaagcccgcttgctttgcccggtccgtcggtgagctgttcaacggcagcggtgatgtcatttgtttccgaattgtcaatccgctttgtaacaggcacgtagtattcgcttgtctctgtttccgccagataatatacagtcagcggatgggtgtctgtcagatcattcactccggccgtttcaatattaatcccgtcttttctgcttaagtcgcccgtaatcggcgtgccgcccacaggcatttctttcagttcgtgcccgttgattctgattttgactttatctattgagctgaattgggtaagcgtccacgtaatcgattgcaggattttttgttcgtcttcttttttatagtttttaaattccttcgaaaaatcagcgactgcagtgccgtcttttttaatatcgacatttaccgtcgtatccgcagggagcaccgctctgaagccgttcggcaggatttctgatacaggccctccctgaaccaagtactcaagggcctgctttgcggttccctcactgttcggaagaggcagtgtctgtgctgcgacatagccgtttttatcaatcagatacagttctcgcatgactgtattggccggctggtcggctttagaagtgccgtttttctctgactgctttggttttgcctgaattcccgcttcatcctttacatatgaaatgtcttgaggcgggtcaatttccccggctgttttatcggattgaaacaaaccgcatccagataacacaaaagccgaagtaagacatgttgcagcaatgactgcaggtccttttttcagcatacttttccctcctaaggctgtttgtactatgatgtatacgagccctgtccgggaaatagaccgggaagcgcaaaaaaacccgctgtaaacagcggggtttttttgatttattttctgaccggctcttgaagggagatgcactcgacatggccgatttcgtggccgaaccagtcttcggcaatttttgcgaagccgttccgctctcccgttgtaagaaattgatgctccggtgcatgtttcgattggtttaacaaacctttataagacaagatggtgctcacttctctcgccgtctcgtctccggaggaaatgattttcacatgctctcccatataattctgaatcgggtcttttaagatcggataatgcgtacatcctaaaatcaaggtgtcaattgatgtaccttttaaaggttcaagcgatgcttcaaccgcttcctccgctgattcctgaagaaaccgtccgctttccacaaacggcacgagcagcggacaagccgtgttctcaacttgaagttctgcgtttaacccgagcagcgcctgctcatacgctctgcttttaatggtattgaccgtgccgatgacgccgatatgctggtttttcgtgacctttatcgccgttctcgcacccggctgaatgacgccgacaaccggaatatccgttttgcgctgaatatcctccaaggcaatggccgtggccgtattacaggcgatcacgagcattttgatatggtggttttccagcaggtaatcggtcatttcccacgtgtattgaagaacttcttcttcaggacgcgggccgtacgggcagcgttttgtatctcccacatagatgatattttccttcggtagctgtctcatgatttccttagcaacggttaacccgccaaccccggaatcaatgactcctatcggctgttccaacaaaatcgcctcattttcttttcatttcatgctgcagtttcaataatgatttttcgaaagcggctgtttcttcttcggaaaatgtcgcaaacatatcccgcaaataagcctgtcttttcaaaatcacttcttggataatgcgctctccttcagcgagaagatgaattctgacgacccgtctgtcagccgggtctttgacccgctcgacaagcttatttttttccatgcggtctatcagatccgtcgtcgtgctgcaagccaaatacattttgcctgataattcgcctattgtcatatcccccaattcataaagccattgaagccccacgaattgcggcggtgtaattgcatattggttaaggatttctcttcctttttgtttaatgatcgcagcgatatggcggagtgatttttcgatatccgcaacatgctctacagattttgatgtcatttgtccatccctcactcaaggatctttctgggctatgcgctccgtgtctattttccttctttttttaagaaaatgcaagactgacggagaaaaaggaaaaaccgggattttcaccgcatgcccatcagcccgggcgccaacgcaaataaccggctccttctcgtaaagaaggaaaaccggcaagaatcagagctctagctcacccattctaagaagctcgacaacagcttgcgaacgccctttcacacctaacttctgcatggcatttgaaatgtgattccgtacagttttttcactgataaatagctcgcttgcaatttcctttgttgtcttgtcttgaacgagcaattcgaatacttctctttctcttttggtcagcagcggctttgattgaaaatctttctccttcaagtattgtaaccctccttgctaaggtgagagcgaatctgaaacgaatgggtttatatagtcaagatatcatatgtaaagggcgcttcggaggtgacgtctcttagagaaatagttatccgttcaggcgagcagaatgcctttctcccgctccgtccagctgaccgctttgccgctttttttcgacacttgaaccataacgacggaacctgtaaagcacggcaggcccgactcattttctccaaggtaatgaagggtgacggacgcatttccggcagcgcttgctttcacataaatccgcagattttcatacggcatcacctgacgcatatagtcgcactgctggcttgcgacgaccgtcatcgtttccgagttttgcgccgtcatgccccgctgtttaaaataagcgatccgtgcttcttcaaaatagatgaaaggggttacattattcatatggccgaacatatccgtttctgaaaaacgaaccgatacttcagtaaagaaagaaaacgactgtctccattcttcaaacgggatatcaatatattgcggttgtttcatcaccttcagctccttataaaaaaacctctcccgtgcggaagaggctctttttctctttcttatactctgtcgcttccgaagaaattacggaatgcttgtaaattggtatctctgttcaaagcagcgattgaagtcgtaagcggaatgcctttcgggcaggattgaacacagttttgtgaattcccgcaatctccgaggccgccgtctgtcattaaagcttctaaacgttctgctttgttcatcgcgcccgtcggatgggcattaaacagacgcacttgtgacatcggggcaggccccatgaatttcgacttgctgttgacgttcgggcaggcttcaaggcagacgccgcatgtcatgcatttagacaattcatatgcccactggcggcgtttttccggcattctcggccccggccccaaatcgtaagttccgtcaatcggcacccatgctttcacttttttcagtgaatcaaacattctgctgcggtcaacctgaaggtcacggacaaccgggaatgttttcatcggcttcagacggatcggctgttccagcttatcaatcagcgccgtacacgactggcgcggtcttccgttgatgaccatggagcaggcgccgcatacttcttcaagacagttcatgtcccatgcgaccggagtggttttctctccttttgcattcacgggatttctgcggatttccatcagggcggaaatcacgttcagattcgggcggtaattgatttcgaattcttcatcgtatggcgcgctttcgggcgtatcctggcgtgtaatgataaaccgtatctttttctcactcatgattatttcgccaccttcttcttcgagtagtcgcgtttacggggcgcaatcagtgatacatcgacatcctgatattcaaattccggagcttcaaacggaccggcatgtttagccatcgtcgttttgagccactcatcgtcatttctttcagggaaatccggtttatagtgcgctccccggctttcatttcggttatatgcgccgagcgtgatgactctggcaagctgaagcatattggagaactggcgggtgaacatcgccccttggttgctccattttgtcgtatcgttgatattgattttcttaaagcgttccatcagctcttggattttgtcatccgttttcaaaagcttgtcgttgtggcggaccaccgtgacgttggccgtcatccattctccgagctcacggtgaagcacgtaggcattttcatcgccgtccatcttcatgatatcggcccatttttcttcttcttttttcacataggaatcaaataatgaagaagacaggtcttccgctgatgtttcaagtccggaaacatatttcaccgcattcggtccggccaccattcctccgtagatggcggaaagcagagagttcgcccctaaacggtttcctccgtgcattgaataatcacattcacccgctgcgaacagtccgcggatgcttgtcatctgatcataatcaacccacagtccgcccatcgaatagtgaacggcagggaaaattttcatcggaagcttgcgcgggtcatcgcccatgaatttttcatagatttcgataatgccgccaagcttaacgtcaagctctttcggatctttgtgcgacagatcgagatacaccatgttttctccgttgatgccgagtttctgattcacgcacacgtcaaagatttcacgtgtcgcaatatcccgcggcacgaggtttccgtaagccggatatttttcctcgaggaagtaccaaggttttccgtctttgtacgtccagactctaccgccctcgccgcgcgccgattcactcatcagacgcagtttatcgtcccccgggattgctgtcgggtgaatttggataaattcgccgtttgcataataagcgccctgctgatagacgattgatgcggcagatcccgtattgatcatgctgtttgttgattttccgaatacgattccgggtcctcccgtcgccataataacggcgtcagaacggaatgactcgatttgcatattggtcagattttgggctacgataccgcggcacgtgcgctcatcgtcaagaacggcgccgaggaattcccagccttcgtattttgtgacgagacccgccacttcatatctgcgcacctgctcgtccagtgcgtaaagaagctgctgacccgtcgtcgctcccgcgtaagcggttctgtgatgctgtgtacccccgaaacggcggaagtccaagagcccttccggcgttctgttaaacataacccccatgcggtccaataagtggataatggacggcgccgcttcacacatcgcttttacaggaggctggtttgccaaaaagtcgcctccgtataccgtgtcatcaaaatgctcaaacggagagtctccttccccttttgtgttgacagctccgtttatcccgccctgcgcgcagaccgagtgagagcgtttgaccggaacgatggaaaacaatttaacggccgtgcctgattccgctgctttaattgtcgccatgaggccggctagacccccgccgactacgataatgcttgattgactcatgatagcccctctccctctagtaatctagttctcttacacaaacgcaaaaatcgcttttaaacctacgtatgaaagcgctaaaaatataatcagcgtcacgtaagtcgaaattctttgagaacgcggcgtaaccgtgatcccccatgtgaccgcaaaagaccataagccgtttgaaaagtggaaaatgaccgataaaacgcctacaatgtaaaaaccgagcataaacggcgagctcagaatattcgccatcatatcgaagttgacttcagcgcccatctgcgcggcaatccgcgtctgccacacatgccagctgacgaaaataagggtgagaataccagtgacacgctgaagcacaaacatccagtttctgaaataactgtagtggccagcgttgtttttcgcagtaaatgctatgtacacaccgtaaaccgcatgataaattaaaggtaagaaaataataaaaatttctaacgcatacctgaacggcagactgtccataaagccggccgccttgttaaacgcatccgctccccttgcggcaaattggttgacgactaaatgctggatcaaaaagatgccgaccggaataacaccgagcaaggaatgcaatcttcgaaaataaaactctctgttcccagacattactttaccccctgtttgatttaagtgcgaaatgtactaaaatctctgcccccacttcgtttcaattgtaagcactttattaaaatttattgacaatttcattttactcctccctcaaaagggcgtcaagaaaacgtgtacataaattataattttcggaattgattatctggagggaaaattttattttcctgcgatatctttctcacattttttcgcgtgttttataggatcatcctgtaatcctcccccctgtttaagctataataaacgaaggagagaggggaatacataatatgaagaataattatgaagcagctttagaacctttaactgaactcgacgtcagcgcatacggctacgaattaatccgggaaatcgtgcttccggatatcctcggtccggatcattcatcgatgatgtattgggcgggaaaacgcctcgcccgcaaatttcctcttcaatcgtgggaagaaatccccgccttttttgaaaaagccggctggggaactttgacaaacgcaggatcgaaaaaacaagaactggaatttgaactggaaggaccgctcgtatccagcaggctcaaacatcagaaagagccttgtttccagcttgaagccggttttatagccgaacagattcaattgatgaacgatcagattgcagaatcttatgaacaggtaaaaaagagagcggataaagtcgtcctgactgtaaaatgggatatgaaggaccctgtataattgaaaaaggcggtgactcaaaagtcccgcctttttgcctgcccgtttatacggcagacggctgtttagacagctcaaacgcatcatgaagcgcttcgaccgctttcaccatatcattttcgctgacaaccgctgatacttttatttcggatgtgcttaccattttgacttgtacatttttttccgccagtacggcaaacatgtccgcggcgacgccgggatttgaaaccatgcccgacccgacaatggagactttcgccagttttctttcggtttcaattttttcatagttaagcgcgtttttatattcttcaagcacggcgaccgtttgggcggcatcttccgttttcactgagaaagaaatatccgcttccccatcatccgactgtgtctgaataatgatgtcaacgttgatgtttcgttttgccagcgcggtgaagattgttgaaagtgttgtcagtccgcttgcaaggcccgtgacggacacccttgtgatctggtcttcaaatgcaattcctctgacgattaaattctgctccattgatgattcctcctcaattaatgttccggcttcatgttccgtgcttgaccgcacttctaaaggcacttggtagtttttcgcgaactcaaccgcccgcgggtgaagaacacccgctccgagatttgcaagttccagcatttcatcataagaaatccccgccagttttctcgctgaccggacataccgcggatctgtcgtaaatacgcccggaacatctgtataaatgtcgcatttatccgcttccagcgctgctgcaagagcgaccgccgtggtatcagaaccgccccgtccgagcgtcgtgatgccgccgtcttccgttacgccctgaaaaccggcaacgactgtaattttgccttctgcaagctgcgaacgaatcgccgtgatatcaatatccgtaattctcgcattgccgtgaacggcttccgtgcggacacccgcctgccagcccgtataagagacggcgtcatatcctttttcctgaagcgccatggccaaaagcgaaatcgtgacctgctcccccgtagacaaaagcatatccatctcgcgtctgcttggttcagatgtgatttcagccgcgaggttaacgagcgcgtcggttgattttcccattgccgaaacgacgactacgacatcatggcctttttgcttttcagcaatggcgcgatttgcggcattttgaattttttcggcagagccgacggaagtgcctccgaatttttgtacgataagacccatactagaccaccctttacattttggttcgtgcgggtgaggagaaaagagcgttttgtccacaataaaaaaagcaatgagaggaatagctctcattgcttttcatatcagtacgattgattatgaacaacgagatagccctccaagaaaatgaattcttgacagccttacatttatttaatgcaaggccagcaaatcacaccgatgggatgtgacacacttcggcgacgctcccctttcagcctttttcgcagaatccatcattctccaaaggcttactattgaagttcgcacctctatcttcaccatataacacgatcttatgaaattagttcacattctagcagatttttcagaaaagcacaatactatttttttaatttttcaaacagcaactgggccgccgcggccggcacaccggcttttttgatatcgtcaaggcttgcttccttcatctttttgacagatccgaaatgttttaagagcatttttttgcgtttttcgccgattccggggatatcatccagaacggattgaaagacgctttttccccggatctgtctgtgaaagctgatcgcaaaacggtgaacttcgtcctgaatgcgctgaagcaggtaaaactcttggctgttccgctccagaaacaccggttcaagcgggtcgccgatcaaaaggttcgatgtccggtgtttatcatctttcgccagtcccgctaccgggacatcaaggccgagctcattctcgagcacgtcgcgcgccgcgttaatctgcccttttccgccgtcaatgatgattaaatccggcagcggaagattttcgcggagcaccctcgtgtatcttcttctgacgacttccctcattgagccgtaatcgtccggccctgttacggttttaattttatatttgcgatattcctttttattcggttttccgtcaataaagacaatcatggccgatacggggtttgtgccttgaatattggagttgtcaaacgcttcaatccgatgcggcgtgtaaatattcagtgcttcgccgagccgttcggctgcaccgattgaccgttcctcatcccgctcgattaacgagaatttttcccgcagggcgattttcgcatttttgtgcgcaagcaaaagcagctcttttttcggaccttttttcggctgatgcacggcggtttccaacagctcgccaatcatgtccctgtcaacgctgtcaggcaccagaatttccttaggcagaaagtgattgtttttggaatagaactggccgatgaaggtcagaaactcttcatccgcttcctgatacatcggaaacatgctgacatcgcgttcgatcagttttccttggcgtataaaaaagacttgaacgcacatccagcctttatcgtaggcatatgcaaacacatcgcggtccagaaggtcattcatggtcattttctgcttctccatcgtcgattcgatgtgagcaagctggtcgcggaattctttagcccgttcaaattcaagcttttcggccgcttctgccattttcgcttcaagctcttttttgatttcgttatgccctccctttaaaaaacgggtgatgtcttcaacaatctcgcggtttgtctcctcagatatatcctttacacatggggcgaggcattggccgagatgataataaagacagacgcggtccggaagctttgagcatttcctgagcgggtaaaggcggtccagcagttttttcgtttcccgcgccgcctgcacattcggatacgggccgaaatagcgtcccttgtcttttttgacattccgggtgacaatcagccgaggatgacgttcatgggtgattttaataaagggataggttttatcatctttcagcatgacattgtatttcggatcgtattttttaatcagattcatttccaaaataagcgcttcaagattggaggaagtcacgatatattcaaagtcctcaatctccgtcaccagccgttgggttttcgcgtcgtgagaaccggtgaaataagaccgcaccctgtttttcaagactttcgctttccccacgtagatgactgttttctgacggtctttcattaaataacagcccggctgatcgggaaggagggccagcttttctttcagttgtttatccatacgttacccttccttacattcatttctcgtgtccattcagtgtatcacgaacatttgtttttctccattctcagcttttggaagatcaaaaaaaggcgacccctttcaaaggaatcgccctgccgtaacggaagctttcggcttacagatgtttgtttacaagctcttcaagagcttctttcggtttgaagccgacagatgtttcaacgacttctccgtcttttagcacgagaagtgtcgggatgctcatgacgccgtatttaccggcagtttcttggttttcatccacgtcgattttgacgattttcagtttgtctcccatttcttgatcaagctcttcaagaacgggcgcgatcattttacaaggtccgcaccaaggagcccagaaatcagccaatacgacaccttcacttgtttcagctgagaacgattgatcagttgcttttacgatagccatttgttattcctccaattgtcaaatgatgatttttagtatagcatctcccattcgttcatgctaatttaatgcttatattattttcccccgaacccgccggaaataatcttatttatacagtgtattataaccgggcggcgggcgttcaaaacttaagatggacctgcaggcagcgtgattaatacaatcgccatcggaggaagctccgcctcaagttttcctcccttttgagcaaacccggaaaacggcttcggtttgacgttttccggactgctgaatgtattgtgggcattcattttttccgcgtgcagaatcgttcccgaaggcgtccctgtctttttcatgccccgcagttcaatcttcacgtcagctttgtgcagatgatcgatattgcaaatgctgatatgtatgtctccgttctgctgtttggacgctgaaatgctgacttgcgggagccggccgtcattccattcgtacccggctgcatttgtttctgccgccaaaagagatgcgtcctggtgcaccttaaacatatcgaacacatgatacgtcggcgtcaacagcatttctttcccttctgtcaggatcattgcctgaagcacgttgacggtttgcgcgatattggccatctgtacgcggtctgcgtgctgatgaaaaatgtgaaaatgcgcggcggcgacaagggcgtcgcggatcgtattctgctgatacagaaagcccggatttgtgcccggctcaggatcaagccacgtgccccattcatcaatgatcagcccgactcttttttcgggatcgtactgatccatgatggcgctgtgccttgtgatcaattcatccatatgcgccgcttttttcatcgtgatgaaccattcatcttccgtaaactccgtcgctgatcctttccccttccagaagtcgcccggtattgtgtaataatgcaggctcagtccgtctatgagatccgcggcttttttcattaaagtttcagtccagcggtaatcgtcgacattcgcgccgccggcaattttatagatttcattaccgctgtaattacggacataggtttggaagtttctgtaaaggccagcataatactcaggatgcatgtttccgccgcagccccagttctcatttcctattccgaaatatttcagcttccacggtttttcccgcccgttttcttttctccagtcggacatcggcgtgcccgcttcaaacgtcatgtattcaatccaatcagccatttctttaaccgttccgctgccgacgttaccggcgatgtacggttcgcatccgagcagttcacaaagcatcataaactcgtgcgtgccgaattcattagaatcaatcgtcccgccccaatgggtattcagcattgttttgcgtttccctacgccgtttgcccaatggtattcatcagcaaaacagccgcccggccatctgaggacgggaatctgaagctgcttgagggcggcggcgacatccgtcctgacccctccggtattcggaatatcggaatcttttccgacccagatgccctcatatatgcctcttcccaggtgttccgcgaaatgtccgtatatgtttttattaatggttccccgtgtgatatcagtttgaatgactgccgtattgtgagacaaacttgatcattccttccccttaataagaatgaaagcactacagccgatctatctgggatgtatgctgtatggataagtttgtaagcgctttacaaaagcttattacattggttcgtacatgtcaatctgttgttttattaatctataatttgtacgaactaattaacacaaaccaaaaccctctgacaaataagccagagggttttgattatgaatgaatattggcatttttaaattcctgagtcagaagcggaaccacttcgaacaaatcgccgacaattccgtagtccgctattttaaatatttccgcttccgggtctttgttaatggcaacgatgaccttactgtttgacatgcccgccaaatgctgaatcgctccggaaattccgcaggcgatatacaaatccggcgtgacgacttttcccgtctggccgatttgaagagaatagtcgcagtagtccgcgtcacatgcgccgcgcgaagcgcccaccgctgctccgagcacctcggcaagttcttttaacggttcaaatccatctttgctttttacaccgcggccgcctgctacgataattttcgcttctgataaatccacgccgtccgccgtttttttgactacttcttcaatgaccgtccgcaaatctgccggaggcgccgcaagctcttcaatatcacccgtccggttcgcgtctttttctaatgcctgaatattattcggacgaattgtcgccagaatgaaaggatcggttgaaatcacctgttcaaaggctttgccggaatagatcggtcttgtaaaaacgatgttatctccggtaacgcttacatctgtgctgtctgaaatcagccccgtttcaaaccgggccgcaagcttaggtgacaaatcttttcccatagaagtgtggccgaaaatgaccgcatcaggcttttcattttcgatcaaatccccgagaattgcggcatatccgtccgccgtatactgagaaagccccggcgaatcggccgtaaatactttgtcggcgccgtactgaatgagttctgatgctgcatcagccgcgccctttcccatcagcacgccgatgacatctcctccgccggaaatggttttgcctgcggctatggcttcaaaggtgacgttccgtaaggcgccgtcacgaatttctccgagtacgatcactttttttcccattctgacatcccccagtttctttaatatcagtttatacgactttggcttcttttctcagcagtgatacaagctccttcgcctgctcagaggcttctccttcgatcagtctgcccgcttctttttgcggcggcagaaaacgttcgatcgttttgagcttcggtgcggcatcatcttcatcaatgccgagatcatcgagctcaagttcttccagcggttttttcttcgccttcataatgcccggaagcgacggatagcgcggctcgtttaagccttgctgtgccgtgatgactaaaggaagtgaggttttaatgatttcggtatccccttcgttgtctttctctgccgcagcttcatcgccgctgattgtcagttttgtaatcgttgtgacgcaaggaatgttcagcagttcggcaagccttggagccacttggccggaaccgccgtcaatcgcgacatttccgccgagaatcagatcatattcccggtccttgaaataatgatataagatagttgaaacggagtattggtcaggatcgctcagatcatcttcaatattgattaacaccgcctggtcacagcccatcgcaagggcggttctcagttctttctccgcatcttctccgccgacggttacggcggtcacggttccgccgtgctcttccttcagctgaatggcttcttcaatggcgtattcatcatacggattaatgataaattcggccccgtcctcctgaatctttcctgcttcaatgacgattttctcttctgtgtcaaacgtccgtttcatcagtacaaatagattcatattcttatcccctttatcttcgcccaccgaattgaggctttcttttttcgagaaatgcctgaatgccttcttttgcgtcatctgatgcaaatgcttccccaaagcgctttgcttcaagctttaagccgccgtcataagaatagaccttgtttgaataaaggagctcaagcagaaaagccatcgactgcgggcttttttccgcaaacttgcccgcgagcgttttcgctttttgcagcagctcttcctcatgttcggcgcctatcgtgacaagaccgaggctgagcgcttcttctccggttacaggttctgaagtgccgatcatttcaagcgctttcgccgtaccgacgtaccggggaagccgctgcgtcccggcaaagcccggaataatgccgagattcagctcgggcaggccgagctttgcatctaatgtagcgattctgatatggcaggccatggcaagctcaaggccgccgccgagcgcagcgccgtgaatcgctgcgataacgggcttcggaaacccttcaattctttccatcagctgctggcctttatccgccatggcagaagattgctcaagattttcaagcgacgtaaattcctttatatcagcgcccgccgagaaaaatttcccctctccgcgaatgatgatgcttctgacactgtcatctgtttcacagcggtcgaacagaccggacaactcatctaaaaccgcgccggacagcgcgtttgccggctgatgattaatggtgatcaccgcaacagattgttctaccgccatcgaaaggctgttcatccgtcaaccccctttagttttgatgaatccctgacaccaacagctccaataccttgtctgacaaatccggaagatcatatttctgatcgttcatcacccatgttgtcactgtttcatctatcgtcccgaatatcatctgccgggcgaggcggacgtcgagattatctttccattcgcccgactcgattccttcggtcaaaatggtgtccagcatgtttaaataaccttttaaaatatcattgattttcagacgcagcttgatattcgactgtctgagctcaagctgggtcacaatcgcgaggtggcggtcattgccgagcagtgtgaaatgctgcttaataacgagagcgagtttttcttttgccgtcgttttttctttcacttcttcttccatgcgttcaatgaactggcccatcttttctttaaaaagagaaatgagtatatcctctttgtttttgaaatataaatagatggtgccgtccgcaacgccggcctgcttggcgattttggacacctgtgattggtgatagccgttttccgctatgacttctactgctgcatcaataatctgcatatactttggccgtttttggttcaatgtcatcgttccttccttcgataaatgaatgactattcattcataacttcatgataaaaaggaatccggattttgtcaagtttttcttttaaggcaccttgttttcatgggaagcatcttcctcttcgactaaacgccttcttaatatttttccgacggccgttttcggaagctcttttctgaattcgtacagcttcgggactttgtacggcgcaagccgctctcttgcaaacgcatcaagctcatcggcatctgcctcggcgccttttttcaaaacgataaatgctttcaccgtttcccctctgtaggaatcagggacgcccgctaccacgatttcctgaacggcttcatgctcataaagcgcctcctccacctcgcgggggtaaatgttgtatccgccggcaatgatgatgtcttttttcctgtcggcgatgtagaaaaatccttcctcatccatatatcccatatctccggtaaacagccagccgtctctgatgacacgcgccgtctcctcctgcttattccaatagcctttcatgacctgagggccttttacgatcagctcgccgtgttcatacggctccgcaagcccgcctttttcttctgaatagattcccgcatcggtattgggccagggacagccgatgctgccgggtttattttttccccagatgaagtttgaatgggtaaccggtgatgcttcggataatccgtagccttccacaagctttcctccggtcactttttcaaatttctgtttgacctcaaccggcagtgccgctgaaccgctcggacagctttcaatggaggacagatcatacttattcagctccgggtgatgcagcagcccgatgtaaatcgtcggcgccccggggaaaaccgtcggcttcaacctgtcgattgttttcagtgtatccaaaggattgaatttaggaagaaggatcatttcacatccctgcataatggaaaaattgagcacggcggtcaatccgtacacatgaaaaaaaggcacgatgccgagcaccttttcggctccctttttcattttgtacatccaggcggcgcacatttctgtattggcctgaatgtttcggtgtgtgagcatgacgcctttcggatagccggttgttccgcccgtgtattgaagcacggcgatgtcatgcgcagggtcaatatcaaatggctctgcttcctctgctttttcgttttttaaaatatccgctaatttgtgaatttgttcgcagccgtcataatcaatatgcacctgttgcttttgcgtgagcgtataaagcatatttttcggaaacggcaaaaagtcttttatacttgttgtaataatgcgttcgacgagtgataacgttttcatttttatcactttcggaaacagcatatcgagggtgatgatcacgcgcggcgcactgtctttcagctgatactcaagctcgtgttccgtgtagagaggattggtctgaacgacaatgccgccggcaaacaatacgccgtaaaaagcgatgaccgactgcggacaattgggcagcataatggcggctctgtcaccttttttcaggcctgttttgcgtaaaaaagcggcaagctttaatgaatctgtgagaacgtcttggaatgtgagtttttttcctagaaaataaatggcggtatggttcgggaattgagctgcggagtttgtcagattggatggcagggtttgatcggtaaattcaagctcatgcggaatctcttcgggatattgagaaagccatggcttttcagactgcataatacctctcccttctgttttcctatacgctattattatagcagaagggtgattggaatgggaaagcgtttcatgggaaatttcgagtttcaggaggtgttgagttttctggaaacgctgcattttgaagggggagttcctatcctgcgccagctgccgaagccgattacgtcggccgcctttttgctccatccctttgtccggatgccagatggtcgggaagagcaaaagcgcaaacggccttatgaacatatgtatccgagtgatgaggagatcatcgcgatgggcagacccgtttcctggcaaaccgtcatgagcatttgcggcctgcgttctgaaaaagaaacggcgcttgcgcttatgactgctgtcacggcattgcgggaggaatatgcacatcctgaatccgccgagcggttaaatcggctccatcatcccgatctgtacttgccgagcgatgatgtcacttcgccatttttgattccgggacttttggatgtgttccgttcaaaaggcataaagcgctgcacttattatgagcctgtcgaagagaaaggcctattttcactcaatcaaacggcggcttcggatgtatgcggactgctgcgggctgacatgatcattgccgatgaaaaaacggcgcgccgcttttatgagcatatatgattcttttacgacactctttctcatggaagaacaagacattcagtctgtcgtccgcgccatgaattgggaagccgtcatttgctctgatacggcctgcataaactggtattctcaataaaaaaggccgccgatttgagttcggcagccttttttcagtattaagatgtcatgaccagataaataagtccgatgaacagaaaaatccccgctgccgacagcagcactttcgcaagcttctccatttttccccgtccccttaaatcccggcggccaccacaaatgacaggccgactgagatgacaaatgaaataaagccgacagctctgttatctttttcaatttctttatcaattttaaaccggggcgtcagaaattcaaagataaaatagctgattaaaagcataataaatccgtatacgccccagccgatcatttgcaaaagcgaattatgctgggcgatgctgtgctgaaagacatttgcgataccgagaattttccctccggtcgccattgccaccgcaagattgcctttttggatttccacccagtttttataggatgtcaccaattcaaacacggtcagaaaaatgacgagacacaagacggcaacactgtaataagccgcgatttcaacaagctcattttcccaaaaagcattcatgacgttttctccctttttattttagttcgacaatcgttacgcctgatcctccttctcccgcttccccgaaccgcgagcttttcacgctgcggtggtttttcagaagatcctgcaccccttttcggagggcgcccgtgccttttccgtgaatgatggacactctcggatagccggcgagcaccgcgtcatctaaatatttttcgacgcggctgagggcgttttcgtaacgctctcccctgaggtcaagttcaagggatacgtgataatccttcccttttacggcggtgattgctttttcttttttcggttcaggagccgatttgagaaactcaagatctttttccttcaccttcattttaaggatgccgatttggacgttccattctttctcgccggttttttcaagcagcgcccctttttgtccgaatgtgagcacctttacttcgtcgcccggcttcagctcgcgttttttctctgtttttctttccggctgctttgatttttcaaaagccggcatcgcgtctccgagacgttttttggcgtcaatcagctcgtgttccttaaaggatctgtgttcttgcttgatggacctgagctcgcggataatctgttcggcttcatttgcggcggcttccagtttttccgcagctttccgctcggcttcttccatcattttatctttttgggcattcagctcaatgatttgctgctgaagctctttgtgcagtttttctgcttcttttctgagtgattcggtttcagaaagttcttcatccgctctttttttgcttttttcaagcgatgcgatcatcagatcgacttcgttatgttcggcggtcatttctgacttcgcctggccgatgatatgctccggaagcccaaggcgtcttgagatttcaaatgcgttgcttcggcccggcactccgatcagaagtttataggtaggcgaaagcgtttcaatgtcaaattcaacgctggcattcatgacgccttgtctgttatatccgtatgctttcagttccggataatgggttgtcgcaagcactctggcgtttgtccggtgaacttcgtcaaggatgctcatggcaagcgccgccccttcctgcggatctgttccggcaccgagttcgtcaaacagcacaagactgttttcagacacgtcttttaaaatattgacgatattgaccatgtgagatgagaacgtactcagactttgttcgatcgactgttcatcgccgatatcggcaaacacattgtcaaatacggctgcttccgagccctcgtcagccggtatgtgcaatcctgcctgcgccattatcgtcagcagcccgagtgtttttaacgtaacggttttaccgcccgtattcggtcccgtgatgacgatcgttgaataatctccgcccagttcaatatcgttggccacgacttgatcttggggcagcagcggatggcgcgcttttttcagacggataaagccgtctccgttcatgaatggttttgtcgccttcattgcttttgcgtatctcgccttggcgaaaatgaaatccagtgtctgcagcacttccacattttgagcgatttcttgtgtgtgttcagccgtatgctccgtcagcatccggagaatccgttcgatttcctgtttttcttttactttcgcctgctgaagcgagttgttcatatctacgatcgcctgcggttcaataaacagtgtagcaccggatgaagatgtatcgtggacaattccgccgtagcttgatctgtattcctgtttgaccgggatgacaaagcggtcattccgaatcgtaacgatggtgtcagacagcattttagaagcggaagatgaacgcagcatcgattcaagccggtctctgactcttgattcaagcgtcctgagctgcgtgcggattccccttaaagcgggagacgcatgatcaagcacttcaccatggtcatcaatgcaggagttaatctccctttccaaatcgcctaatgtaatcagctcttctgcatgggcctgtatcagcggtatgccgacgccgtcttctgtcatttggctgataaaatgcttcatttgtttaacggcatacagcagcccggacaattcggtgaattccgccggcgtcagcacactgccgatttccgcccgccgtaaagcggatcttatgtcggtcaggccgccgaacggagcatggcctcgcaagcgcatgaccgcggatgcttcttcgacttcatccagctgtttttggatgtcggcgagatccgtcaaaggtttcagctgcagaagcttctccctgccgagcgatgaggcggcatgtgcggtaatctgttcttttactttatgaaattcaagtgatgataacactttttgctgcacggttttatggtcctccttacttaatcattgcgcgtcagaaatgctttgacctcatgtaacggccgggcgtttaacacatgttttgtctctgtccagcctttgcgcgcagcggtcacgcccgttttcatatcatcgagcatctcgatattatgggcatcggtattaatgaccaaagtcacacctttttcatttgctttgatcagatgctcagtccgtaaatcgaggcgcgcggggtttgcattcagttcaagcgccgtatttgttttggctgcgagctcaatcagcatgtcgatgtcgacttcatagccggcccgtctgccgatcaggcgtcccgtcgggtgggcgataatgtccacgtgcttattcgtcagcgcctgttcaagccgtttcataatgacatgctccggctggctgaagcttgaatgaatagatgcgatgacaagatccatttcagacagaacgctgtcatcataatcaagcgaaccgtcggggagaatgtccatttctacgcctttaaaaatatgaaaattttcaaattcagcgtttaacgcgtcaatttcttccgcctgttttctgagccgttcggccgttaacccgttggctacctttaaatattgggaatggtcggtgatcgccatgtactggtagccttttgccatacacgcttctgccatttctctgatggaaaaagcgccgtcactccaggctgagtgcatgtggagatcgccttttatcgctttatgctccacaaggtccgtttcttcccggtacgtgtcgacctcctgcccgctttctctgagctcaggaggaataaacggcagaccgaagtgggcgtaaaacgcttcttcgctcgggaatgttttgacgtctcccgtttctatggtttctactccgtattcactgatccgttcaccgcgctctttcgccagctgacgcattttaatgttgtgatctttagaaccggtaaaatgatgcagtgtggtggcaaactgttcctctgtcacaagccggaaatccacactcgtctcgtattcaaaggtcaggataaccgatacttttgtatccccgcccgctatcacgtcttttacgttcgggagggaaagaagctgttctctgacagcctccggacgatctgtagcgataatgtaatccagatcttttacggtttcccgcgctcttctgagactgccggcccgggaatatttctgaatatccgtcagccgggccaaatgttcttcaatgactgaagcaatgctgagcgcatagccgatcggaaaccgttccggctgttttccggcttctccgagagcctgaaggattttctcctccgtttttttgccgaaaccggcgagcccctgtactttttgctgctcgcatgcttctttcagcgattccgcgtcatgaacgccaagctcctggtacagcttggcgatttttttgccgccgaggcccggaagcttcaaaagaggaaccaagccttccgggacttctttctgcaattggagaagcgtgccggacacaccttcctgcatatattcacgaatgacgccgtaggtgccttttccgattccggataaagacatcatgtcgtcgatttccgacaggctgcggtcatcctgctcaagcgccgccgccgcttttcggaaggctgatattttaaacgggttgtcccctttcagttccatatagaccgcaatcgtttcaagcagcctgatgatatcttttttatgcatactgttaacccccagtcgtttcctgcttttcatcatacaaatttttctcttccggcacaactgacgcagagcttgaaaaaaacttctccggtcaagagaagttttttatgccccgtactgggcccacagttcttgcaggagccccgacagatacggcgtatgatgtgtgatgatatttgcaagcgtcgattgtgcgagcatatcctgaagcacgcttaccggcagtacggatgcgacgtataacaggataaacgcaaataaatagacttccagaaatccaagcaccccgcccagcagtttgttgatctgtttaatgaccggaatgccggcgatgatattaagcgccgctccgataatccggagcaggatctttgcgatgataaacaaaatgacaaacgcgatcgcgttgtaataagccgtctccacgtttcctttaataaaagacagagccgcctgcccgccggaaaaatcaggggcgggtataaagctcagatgcggggccaggtttttgtaaaaaagcgccgcaaacgcaatcgagaggatgaaactcgtcaagtatataaattggaggataaatcctctttttaatccaagcaatgtgcccattaagagcagaactaagatgatgatatctatcatatggtgttcattccttttctttaagctgccgctccagtatttcatatttttcttgcagtttcatataatcatgcacgacattgaccgcagtcaatacagcgagcttatttatatcaagatatggatttttctcgttgatttctctcattttatcatcaaccattccggccacatggcgcatgtgcgctttgctttcttccccgataatggtgaagtgctggccgtaaatgtttactgtcgttttggtttttttgccgtcagacaacgtttctcctccattccgcgagaatcctagttcctatcataccacgattatcgtttgaatggaaagacaagcctcgggctgttatgatacactggtatatacagtgaaaagtgccaaaaaaggagattatatcgtgtcccattctgttataaaagtatccgcttccgctatggaacaaatgaaacaatcctatgccggctcccttactcccgccgttccgcagggcgccgtcttccaggccaagcccccgggctgtaccattacagcctaccgctcgggcaaggttctctttcagggaaaaaacgccggcacagaagcggcccgctggggaacggctgaggcgccgaaggcaaagaaaaccgtcaaaaaagcggccgatccgctttacgctcccccggcgggcattgcctccatgtcagtgatcggctctgatgaagtcggaacaggcgattacttcgggccgataacggttgcctgcgcttacgccgacaaaacaaagctttctttaatgaaagaactcggtgtgaaggattcgaaggatttaaaagatccgcagattattgaaatcgccaaactgttaattaaaaccattccttacagcctgcttgtgttgaaaaacgaaaaatacaatcagatgcaggaaaaaggcatgagccaaggaaaaatgaaggcgctccttcataatcaggcgatttccaatctgctgagaaaaatgaacggcgttaaaccggaagcgattctgattgaccaatttgcagagcccggcatttattttaagcatctttccggacgggatatcgtaaaagaaaaaacgtttttcagcacgaaagcggaaagcatacatctttccgtcgccgcagcctctatcattgcgcgatattctttcttaattgaaatggataagctttcccgtgaggctgggatgacgattccaaaaggcgcggggccgcacgtcgatgaagctgccgccaagctgatcatcaataagggagaaggtgcgctcagaacgttcaccaaacttcattttgccaatacgcaaaaagcgaaacgccttgtagaacggaaacggtcataataaaaaaagcttgcagaatgatctgcaagctttttctttatcctcttaataccgcctgatacgtttcttccagcgctttcagcacgttttcatgtacttttgtcacttcttcttctgtcaatgtttgttcagggttaacatattggagcgagaaggcgacggattttttgccctcttccatatgctcaccttcgtacacatcaaatacggtgacttctttcagcagcgcgccgccggcttctttgatcacggcttcgagctgtccgcttgtaacggttttatctgccacaagcgcaatgtcgcgcgtgacggacgggtacttcggaatcggcgtatacacgacaggttctgtttcctcggtcagaagcgcgtgcagatcaagctcgaacacatacgtttctttgatatccagctctttttccattgccggatgcacctggccgataaatccggcaagcgaaccgttcaatagaatgtttgccgtccggccgggatgcatgtttttgcgtgcagactggacaaattcaacccgatctgacacattcaattgatgcagcaggccttcaacgattcctttggcgacgaagaaatcaaccggctttttctcaccctgccataaatttttgcgccacaatccggttacagctccggcaacccgttctttttcaaccggttttgtgttttcttctttcgtcagaaatacagaacccgtttcatataaagcaacggaatcagtctgtctggccagattgtatgaaacggcttcaagaagattcggcacgagactgtgtctgagaatgcttctttcttcgctcatcggcagagcaagcatcgtgttgaatgatttttcgatcgcaaaagcggccgcttttttatcattcgttaatgaataagtggtcgcttgtgaaagacccgctccttcaaggaaacgtctcactttccggcgttttgcctgatacggtgtcaagccgcctgtcgtgccggccgtttccggaagcgtggacggaatattgtcatacccgtacaatctcgccgcttcttcaatcaggtcttcttctattctaatatctccgcggcgggacggcactgttacgacgagaacgtcttcagcttcactgactgcaaacccgaggcgcttgtaaatgctgatgatttcttctttagcgattgccatgccaagcacggcgttcactttttcaacagacacgtgaatgttgtttgcttcgattttcagatggttttcttcaaccgtgcctgagagcacttctccgccggcatatgcctgaatgagactgcaggcccgttcagccgccagcaaaacgcgggccggatcaatgcctttttcatatctggcgctcgcttcgcttctcagtccgaggtctctcgacgctttgcggacggtctgtccgtcgaaataagcggcttccagtaaaatcgcagtggtgtcttcacggacttcagactcggctccgcccatgactcccgcaacggcttgcgctttttttccgtttgtgatgaccaaatggctgcttgacagcttgcgctcttgttcatccagcgtcacgatggtttcgttttccgccgcttttctgacgacgacctcttttgaaccgaaccggtcgtaatcgaaagcgtgaagcggctgtccgtactcaaggaggacgaagtttgtaatgtccacgacgttattatgcgggcggatgcctgcattcatcagcttcgtctgcatccaaagcggtgacgggccgattttgacgtttttaatgatttttgcggcataatgcggattggcctgcgtatcttcaatcttgacggaaacagcatccgccgctttttctgccgctttttcatatgaagcctccggaagctttacctctgcgccgaggatagccgccacttcataagccacgccaagcatgttcatcgcgtcggcgcggttcggcgttaagccgaattctaaaatcgcatcatcaagctgaagggccgccattgcgtcagctcccgtttcagcatcattcggaaaaacgaaaatgccttccgcatattctttcgccacgagcttgctttcaatgccgagctcctgaagggaacagatcatgccgtgagacgcttcgccgcgcagcttggcttttttaattttgaaattgccgggaagcacggctccgaccgttgcaacggcaaccttctgtcctttatcaacattcggggcgccgcagataatctgcacgggttcctccgcaccgatatcaacaaggcatttgttgagtttgtcggcattcggatgctgttcacgctcaagcacgtgtccgatgacaacgccttttacgccctcccctttatactcgataccctcaacttcaataccggctctcgtaattttttctgcaagcacggccgggtcgattccctgcaagtcaacgtaatcttctaaccatttatatgaaacaaacatgtgtatcctcctcttacgcctgtttaaactgcgaaatgaatctgacatcattggtatagaaatggcggatatcttcaatgccgtatttcagcatcgcgatacgttccacacccattccgaaagcaaaaccctggtattcctcaggattgaatccggccatcttcagcacgttcgggtgaaccatgccggcgccgagaatttcgatccagcctgtttttttgcagacggagcagccttgtccgccgcacttaaagcaggtcacatccacctcgacagaaggctctgtgaacgggaaaaagctcggacggagcctgatttcacggtcttggccgaacatttttttggcgaccaattcaagcgtgcctttcaggtcgctcatgctgattttgcggtccacgacgagaccctcgatctgcatgaactgatgggaatgtgtcgcgtcatcgttgtcgcggcgatacactttaccgggacaaatgattttgacggggccttttcctttatgcttttccatcgttcgcgtctgcaccggtgacgtctgcgttctcatcagcatttcttctgtaatgtaaaagctgtcctgcatgtcgcgggccggatgttccttcggcaggttcagcgcctcaaagttgtaataatccgtttccacttcagggccttcttcgacggtatatcccatgccgataaataaatcttcaatttcttcaataacgaccgtcagcggatggcgtcccccgatgtttacctgactgcccggcaacgtgacgtcaatcgtctggctgctgagttttttattcatctcttcttgttcaagctgttcatttttcgccgtaatggctgctgcaatgcgctctctcacttcattggcgagcgctcccattttcgggcgctcttcggcggacagtttgcccatgccgcggagaacttctgtaatcggccctttttttccgagatattgcacccgaatgtcgttaacttcttttaatgaacccgccgcttctactttttctgcagcttccagttcgagctgtttaagcttctcttccatcatgcatcctccttttatgtaaaccaaaccgttctatgcctttttcagaaaacaaaaaaacccgccccttgagagaagggacgagttgtggccgcggtaccaccctttttaaggcagacttcatctgccgacagcttcattgacataacggaaacgatcgttccggttcacctttacgcgcgtttggcgcggtcccggtgacaactcgagaggtgaaaatcaatttctgtgctgcgataaaaatgctctcagtcagcggcattttctccctggaaggcagcgtgtgcaaaaattgacgtcctctgtcacggtttttacattattgctatctattatagtgaaatccaaggtttttcgcaacctatcctctgagatgataaacgaggatggcggccgctaccgccacattcagcgattccgcctgtccgtacagcggaacgtacagattgagatcggttttttgcagaaggccggcgtccactcccgccccctcgttcccgacgattaacgcgaacgattcttcaggcttcacgctttgataagccgcaccgttttcaagcgccgtgccgtagatcgcgacgccttgtgatttcagctcggcggtaaactcatcaagcggacgttttaaaatgggaatatgaaaatgagatccttgcgctgaacgcagcgtttttccgttgtacgggtctgccgttccctcaccaaggacaacggcgtcgattcccgccgcatctgccgttctgatcattgttcctaaattccccgggtcctgtacggcatcaatcagaagcagccgcttcagctgatcaggccgcttatccggcatatggcagaccgcggcgatccgctgcggcgtttccgtttccgtcacggctgaaaacgcgtcttcgctcagcacgtagcacggaatgctcatatccagatcggccggaatggcgctctcatcgtttacgagaatttcttttaccgttccctttgatttgagcgcttcttctgccagatgctctccttctatcagaaatgtattcgttttaagtctctctttttttgtgtgaagttttttccagtccttcactttttggttttttgcagagtcgattcgtttcactttatgtctgtgctctccttttttcatgcatgttgttattatatctcaagaacagcacataataaaccgcgtgcgcggtaagaatatgcgtatcacattcaggaaaaaggagcggttgtaatggatcttaatttacgcaacgccgttattgccaatgtaaccggcaataaccaggatcagctggagcatactatcgttgacgccatccaaagcggtgaagaaaaaatgcttccgggcctcggcgtcttattcgaagttctttggcagcatgcgtcagactcagaaaaaaatgaaatgctcaaaacacttgaaggcggattaaaacctgcgcaataagcatgaaccgggtgatggcacacccggttttttttgtataataatggcgagggggatcgccatgcagttacagccggaactggcaaagaaattgattgccgaagtcaaacatatgtacagccgcgaagtgattattgccgatacaaaagggatgatcatcgcgggcaccaatgaggcgcgcgccggatggtttcatgaaggcgcactgatctgcgcccgcgaaaaacggaatgtcatcattacgaaagaagatgaaaaacgcctccagggcgtaaaagcaggactgaacctccccgttttttcaggccatgaggtaatcggagtgttcggtctgacaggagaccctgacgatatcctgcctttcggagaattgctcaggaaaatgacggagctgtttattaaagaaacgcgccatatggaagaagcgcagtggcgtgcgagaatgcttgaatcctttatggttgattggctgcagctgaaagaatggtctccgggctttttagaaaaagcaaagctcatcggcgcagaccttcacgcataccgccggatcatactcattcaaggacgttatgagcaatataaagcggaggagctcgggcggctctggcagaacgaatgccctgaagacctgtttgtccgctggggaaatgaacgcattctcattaaccatgaagcaaattcggcttccaaaacacagctcatcaaaaagatcggcgccgtttttgggcagcctgtcaccgccggcatcggacggatcgttccgggagagcgcctcgcggaatcatacgaacaggcggataaagcactttcagccggaatcggtgacaagcaggccgtctttgaagaagatttaaaactggatatgtgtattgccgatatcgcgcccggcacgaggtcggaattttcacggcgggttctcgagcatgtactcggccgggaagaacttctggatacgctgcgcgcctttttcgaccggcaattatcgttaaagcgcaccgcagacgacatgcatattcatatcaatacattgcgctaccgtctttccaaactggaatcactgacaaatatgaagcttgaccgccccgaagacataacggctttttatttggcgctccgctttttagatcaacatacaaaaagcacgtaatcatatcatcatttttcatatgtttctccatagtgtgaagaatcgtttttctttacaattaaatgaaaacgcttttcttatcagggaggttggagaacatgatttcacgagaggcaaaagaagcgttcatccggacggtcgggaaggagaattatgatgattcggcggctggccgtcttgtgtattcttacgatgcggctcctcagctgcaagccatgccggatgcggtaatcgctccccgcagcgcggatgacgtgtcccgtatattaacgatttgcagcaggcatgacattccgatcgtgccgaggggttcaggcacaaacttatgcggcggcacatgtccgtctgaaggcgggcttgtgcttttattcaaacatatgaaccgcattcttgaaatcgatgaagaaaatttgacggcaaccgtccagccgggcgtgatcacgcaagatatgattcatgcggttgaaaggaaagggttattttatccgcctgatccgagcagcatgaaaatatcgacgatcggcgggaatattaatgaaaattccggcgggctgcgcggtttgaagtacggcgtcacccgggattatgtcctcggccttgaagccgtcttggcttcaggcgatatcatccgcacaggagggaagctgacaaaggatgtcgccggttatgatctgacccggcttttcgtcggatcagaaggtacgctcggcgttgtgacggaagcgactttaaagctggttccgaagccggaaacgaaaaaaacgctgcttgcactctatgaacatattgaagcggctgcggaatctgtttctgccatcatcgctgaaaaaatcattccggcgacactcgaatttctggatcagccgacactgcaggtcattgaagattacgccaagatcgggcttccgaccgatgcaaaagcggtgctgctgatcgaacaggacggtgacatcgaaacggtcagacgagatatggaaaaaatcgaagccatctgtaaaaacggagcagccgtatccgtccaaacggccgaaaccgaggaagaggcattcgcgcttacagaggccagacggtccgcattatcagcccttgcccggctgaaaccgacgacgattctggaagacgcgaccgtgccgagatcacaaattgccggcatggtcaaagccattaacgagattgcagaaacatacggcctgtccatctgcacattcggccatgccggagacggcaacctccatccgacgtgcaccaccgatatccgaaatacagaggagatggaacgtgtcgaaaaagcttttgccgccatttttgaaaaagcgattgagctgggcgggacgataacgggtgaacacggggtcggcatcgtaaaagcgccgtatttagaaatgaagctgaaaacagaaggcattaccgccatgaaagcgatcaaacaagcgcttgatccccaaaatctgctgaatccgggaaaaatattcgccaattcatcaaggaaacgcgtggtgatgatgaaatgacaacggctaaagagcagcaacacattcaaacagaattcaaaaaccgcatggatgaaggtgaattgctgaactgtatgcgctgcggcttctgccttccttcctgtccgacctatatcgaatcaggatttcaagaatcccattcgccgcgcggccggatcgccctgatgaaagccgtcacagacggactgatcgaaccggatgaagatgtcgagcgctcactttcgctgtgtctcggatgccgggcatgcgagcccgtttgtccggcaggggtcaattacggacagctgcttgaagaagcgagggatatcattcatcaaaataaaaaacataagcccggcgtgcgcctcttgcggaaagccgccttcaccgggcttttccctcatcaaaaccgcatgcaggcagccgtgaatcttctcggaatataccaaagatcgggactgcagaccgccatcagaaaaaccggtatgctgcgcgttttgcctgaacatctgcgcacaatggaacaagtgctcccgcccgccccgaaacggaaagacatgaaggaaaggccgcgttttcttcctgccgcgggtcccgtccaaaaacgggccgcttttttctcgggctgcttaatggatacgatgtttttagcaacaaatcatgcgacaacggcgcttttacaggcggccgggtgtgaaatcgcggttccggacggccaggcgtgctgcggcgcgcttcacgggcacagcggagaaaaagagatgggaaaagaactggccaagcggaatatcgccgcttttgaggcgcttgacgctgattatatcattacaaacgccggcggatgcggcgcctttcttcaggaatatccgcatttactgaaagatgaacctggatgggcggaacgtgccgaacaattcgtccggaagctcaaagacttttcatccgtactggttgatctgaagttccatcaaaaaaacctgcgggcgcagtctcctcatatcgtcacatatcaggactcctgccatctccgcaatgtgatgcatacgtcagaagaaccgcgcacgcttttgaaaaacattaaaggggctgagtacagagaaatggaaaaggccgacagctgctgcgggtcggcgggaatttataatataacagagtcagaaatgtctatgaaaatattagacagcaagatgaaagccgccggaaaaacggaggcggccgtcatcgtgacagccaatcccggatgccttctgcaaatgcagctcggcattttacgcgaaggattaacaggccgtgtccgcgcggttcatttggcggattaccttttggaagcggcggatttgtcataagccgaaagcagagagaccgatcggctctctgcctttatgatgctacaatgttcggatcggccgcggatttatccgggtattgaagcttccagtctggcactcggatcacgccatacattcgcccattttttcacagccgcaatgataatcacaagcccgagaatcagcatgataatggataaaacgccattcagcacgttgtatcccgccgcttcggggttcaaatacacataccgcaccatccaataacccgcatagttgacggtcacgtacaaataagcgagaggaatcaggcatgtcagcatatagcgccgcttatccgctatttttaatacgacggtcgcaccgatgattaagccgacagatgccataagctgattggatacgccgaacagcgcccaaatggaactgatgtcgcccgaatacagaagatagccccacagcaggcaggcgagcgcgcttgagaaaatcgagcccggcagccagtctgtttttttcagcggcttatagacctctccgaaaaactcttgaatcaagtaccgggcgacacgggttcccgcatcaatcgccgttaaaataaacaccgcttcaaacataatgacgaattgaaaaaagtatgaagccaaatgactgaaaaacggaatctccgtaaagatatacgtcattccgacggcaagcgtaacggctccgcccgttcttccttccagactgagcccgatttctttactcaattcaggcagatggacgacattcatcccgagggcgcggaatatttcaggcgtgctgttaatggcaaaatagtcggcgggctcaagagcggcagctgcaatgagcgccataattccgacgagacattccacaagcatcgctccgaaagcaaccggttttatatcactccatttatccagcattttcggcgttgtgccagaaccgacaaatgcatgaaagcccgaaatggcgccgcaggcaatcgttattgaaataaacggccagacaggacccgcgatcaccggccctccgccgtgaataaactccgttacggccgggaatttaatggcgggattgacgaaaaagacgcctgcgatcaaagcggcaaaaaccccgattttcataaaactgcttaaatagtcacgcggagccagcaaaagccaaaccggaagcgccgcggcgaaaaacgcatagacgggaagcgccactgcaagcgttttcgcatcaagtgtcagcatgtccccgagagccgttgtctgcagccgcggcccgattacaacaccggccattaacaaaagaaacccgacagttgatgcgagtttgagattgcccgtttttttatagtagaggccgacccccatcgcgatcggaatcgtaatccccaccgcaaacgttccccacgggtttttctcaagcgcgtgcagcacaaccatggacagacccgccatcgtgatcgtaatgataaacagcatggaaagaccggtgcaaaagcccgccaccgggccgagctcttctttggcgacttcagaaagcgttttcccgtttttccgcattgatgcaaacaatacgacaatatcgtgcacggctcccccgatcaccgctccgattaacagccataaaagcccgggcagatagccaaactgagctgccagaatcggtccgacaagcgggccggcagcggcgattgccgcgaagtggtggccgaatgacacccacttattcgtgggcacataatctttcccatcctcaagcacatgggccggagtcggtgtctgatcattgatttttaatactttgaccatcataaaggtaccgtaaagccgataggcgatcgccaaaatacatatagacgctatgacgattgtaatcgcattcatttaatcccagccccttttctctttttctaaatattatcataattatcagataacaggagatgatttttgcgtaaaaaaaagccggcagcggcagcccggcttttcggaacattattttcctgataaacggatgacattccaggacagcggagtaaaatgtgccgttatcccttcagcgtttgccgaagacgttccgttggagtgaggaatgacttcttttctgtttttttgattggttgctttcatatcctgatgctccagcacgatatgctcaatgatgcggtaatcttcaaaccccctcagtttgatctccgtttccatcggttccttgcttttgttgacggcaaaaatggtcagtgcttcatcctcttcatggtaaacggccgcggcatcaacatacggcacatccgtaaagtccgccgagtcgtatttcggggaggtgatcagcagcttcatcgaagtccctctcccgtagactgaggcgtgcatgtaagggtaaaagatcggctgcctccatgcttctccgcccttttcagtcatgataggcgcaatcacgttgacaagctgggcgagacaggcgatcttcagtctgtccgcatgctgcagcatcgtaatcagcagtgaaccgatcaacagcgcatcttcaaaattgtagatgtcttcgagaatcggccgggccgtaatccatggctccacttttttatccgcttcatttgagtgataccacacattccattcatctaaagaaaggtgaatcgtttttttgctgcgttttttcgctttcatataatcacatacggctgtgacggatttaataaaatggtctaaatccatagacttcgccaaatagttctcaagatcattttcatggttgccgtaatacgtatgcagtgaaatgtaatccacatgctcgtacgtatgctcaagcacctcggcctcccactcgatgaaggacggcatgccgctgtttgagcttccgcaagccaccaattcgatcgtcgggtccgtccatttcatcacctttgctgtttcagcggcaagccgtccgtattcatgcgccgttttatgaccgatctgccaagggccgtccatctcatttcctaagcaccatgttttgatgccgtaaggtttttcatatccgtgcgattttcgtaagtcgctccagtatgacccttcaggatggttgcagtattcgacgaggttccgggcggcatcgattcctctcgtcccgagattgaccgccatattcacttcggcgttcacttttttcgcccacgttaaaaattcattcgtccccacttcgttcgtttctgtcgtctgccatgccaaatcaagcctccgcgggcggttcttcaccggcccgacgccgtcctcccaattgtagcctgagagaaaattccctcccggatagcggatgaacggcacttgcaattccttgattaactcctgcacgtctgttctgaaaccgtccttgtcggctttcgggtgtccgggctcataaatgccttcatacaccgcccggcccatatgttctataaaagatccgtacatccgtttgtccacttcaccgatgatatattctttatctgctgtaatccccgcttttttcattacatttcctccctctctctatcccttcactccgcctactgtgaggccggaaatgaagtatttttgaaaaaacaagaatatgatgatcaccggcagtatcgcaaaaacggacccggaaatcagcatgtcatagttgttgccgtacggactcagcagccctgaaagtccgattggaagcgtaaacatttctttcgaccgaagcacgatcagcggccataaaaagttattccagctgtttaaagattgaagaatgatcattgctccgaatgccggtttcatgagcggcgccataattctgaagaaaatgccgaattcggtgcagccgtccattctcgctgaatcaagaagatccttcggaagtccgagcgcatattgccggaaaaagaacacggcgacaggcgacacaataaacggcagaatcacccccgtataagaatcgattaaatgaagacccaccgtcaatttgaacaacgggagcatcatcacttcaagaggcaccatcataatgatcagcacaagaacgaaaataatatttctgcctttaaactcgtagacaccgagtccgtagccgatcaaagaggaaaaaaacagcgtgagaaccgtggtgaggacgccgagcagcaggctgttaaaaaaccatttaaaataaatgctccccccgttgaacaaataggtgtagttatcaaggctcatcacatccggatcaagacgcagattcagcccgatgcgcatcagctcagatgacggctttaatgaaccgagcaatagacagatcatcggaaagatatacaacaggctcagcatgataaaaaacaaggtaaacgcgactctgtacacggaaaacatgtgattgttacgcaacgcttatccctcccctttaaacgaaccggacagtttcagtgaaacaaggctgactagtaagatgacaagcaaaaggacaattccgattgctgccccgtaccccatttcgttgtatgcaagcccctgctgatataaataaccgacaagcgtgaggccgatattgcccggggaattattctgccaaagcacatagctttcctcaaacattctgaaaccgccgatcatactgatcgttaacacataaacggacaccggctttaaaaatggaagggtgatatgccggaactttttccacgtactcgccccgtcaatttcagccgcctcatacaattctttcggcacattttgcaaacccgccagaaagtaaagaatgttaatccccatccacctccatgacgcaagcagcaccattaaaaacatgccggtacctttgttgttgagccagttttggggtgatgcgccaagcttcatcatcagctcgtttgcaagcgacgtattcatttctccgaacatcagccggaaaataatccccgctacgatcgtcgatgttaaagccggtacaaacagagccgatttaaacacatttctgaacctgacgagcttcgaattcagaatcaccgctaaaagaagcggcaccggaatcagcacgatcagcgtccagaaagtatattccaatgtgttaaataatgccgtataaaaggttggattaagaagagcggtataattggaaaacccgacaaatgtaatttctcccggcagtatccgctgaaagctcatgataaacacgctgatgatcggatacaaaaagaaaacgagaaacgaaatgataaatggcgccgtaaaaagataaggcgccgctttttttgaatacagcacattgcgccggcgcggcttcttccggactgcagaaacggtttgcgctgtctctgtctttacaggtctcataaaagctcccccgctttcactgttaaatagggcggcttctcctatttttctaattgctctgccgcctcgtccaaggcttcctcaggtgttttttcctgcgtcttcagcgcatcgaacagcacctgtctgacaacgagatcagccgctttagagaagtcttcatgcagataaatcggattgatctcatcttttatttcaaggagcgaggaaaaaattgacgtaccgttccggaagaaatccgtgtacttgtttttctccttcaattcttttgaatcccacacgtcccagcggagcgggtcaaagccgagcaccgtccacagctttatgttcccttcctttgaacctttcgcaaatccgagaaattctttcgcgagctccagatgttcagcctgcttcggcacgacggtggctgttccgcctaaacccgctgatctgtcaccgccttctttccaggccggcatagggtaaatcgccattttcccttttaaatcaggcatataatcgataaaccgtcccatgtaccaaatgggcatcagcactgaggctgccccgccctgattcataaaaccgtagtattcttcgctgtgatggccgccgccgggagccggcagaagggttttatcatttaccatgtcctttacatcattcagtgtatctgtattcgtcttgctgttcagaatcaattttccgtttttgctgtagtagcctgacccttgctgcgaaatcatggataggaatgtggcggagtcgtttgtttcaaccgttcccatcggtttcccagcggcttcacgcactttttttcctgcccgccggtaatcttcccatgtcttaatggaggcgggatcaacgcccgcttttttcatgatatccatgttgtaaaacatgacggtcgtccccacatgtgtatcaaggccgtacaattttccgtttttgctgtataaggccagacgcgcttccacaaacttatcgcggtctttttcaatcagcggcgtcagatcggcaagcgggatatccttccccttcagaaagttcgagaaccggcttaattccacgtcggctatatcgggaagcccctcacccgcgatcagcgaaaccgataaattatcatgcatttgtccataaggataaacaacggtattcagcttgattttgcgatccggatacttctgattccattctttgaccatttcctgataaaactgttcgtgcagaccgttaaacgtccaaaacgtcagctccgtttctcccggccggccggcagtccgttcttgtgaacagccggcggtaaacaagaagagcatcatcagcaccaaacatacagcggtcgtttttttcatgtcattaccccttccactttaggccgtgcggctattgatgcaaatgatgtgcaaagagcgctgcattttcatttatgatggttaaaccggtataacggtctcgcagtgtgtgcgcatgcttaagcgcatcgctgacaaggtccttttttacaccgatctcatcgaaacaggcgggacctcccgcagatgagagccacccggcaattgttttgccgtcgggaagcccttcatatgcggactgaatcgcctcgcgaaagtgcggcggcagttcagcaagcttttcgtgacaagccagttctttgtaaatatcactcagcaccgcgcacgcacagccgaccttcgcaccgtggagaatcggaggctgttttgccttcagcatttccatctcaatccaatgcgagatgtgatgctctcctcctgaggcggggcgggagtggtcaagagcaagcatgacaagacccgaaacgatcagcgcttccatcagtatctgaatgccggcctccgttcccatggcaatgtcagcgcggtgatcaatgcactgccaaagcgcgtctttcacaagcttcgccccggcttctgagtacggctcacccgcaagcctgcgggaaatctcccaatcagccagcgatgttattttcccgagcatgtctccgaagcccgcggctgtcattgaacggggcgcttcttttaatacattcgtatcggcaaataaggcgatgggcgctttcgtttgaatcgtcgttttgattccgtttaatatgagcggcgctcccgccgatgtaaaaccgtcgactgacggagcggtggggaatgagataaacggcaatccgcgctgataagcggcaaaccgcgtaatgtcgtgaatcgttcctgaaccggccgctatgataacatccgtctcttccgcgagattgatcagcgtatagaccaatgtcctctcatcagccgcggcggccccggcttcatgctccggaatgatgacttttgacgctttgattccgcctgcccttaattcgtccgcaagcagacgtcccgccgcctcgtacgtgttccggtcacagacgatgaccggatgattccagcattttttttgcagaaatctgagaagctcttcttttgcattcgccccgatcacgatatcttctatttgaatcggtgagcggctggccccttccttgtcaaactcggattgaatgtcctcaggagaacgtttcataaaaggattccctccttcgctaattctgtcaggtctttaatagaatcaaggacgatgtcaggttcatatagacggggctccccaagtttggccgaccccgtcagaaccaatatgcttttcattccgtacagcctgcccattgcgatatcagattcgaggctgtctccgattatggcgcattcctcagggggaagtccgagcgcttcacatgccgcctcagccatcagccaagacggtttgccgatgacaagctccgtttttgctccggcggatgcttcaatggccccgatcattcccgcgacatccatggcatgaccgccttcattcggaaaggagcggtctttgttcgtggcgatgatgcgcgcgccggaggaagccgccttaaaagcgagattcagatccttataggtgacggtttcatgcagggagatgacaagccagtctgccgcctgcgggttttgcgccaggacgacacccgctaaagcgagttcatcagtcagccctttctctcctaacacccagacctttgacaaaggataatgcttctttaaaaatgatgccgtcacactggaggacagcacgatgctccgttcatccgtgcggataccggcacccagcagtttctttctgcacattgcttttgatagattgccgcggttgcttaaaaagacaacggctttgcccagtgactgaagggtatgaacggcttcttttgcgccgtcaatcagctcccgccccctgaatacggttccgtctaaatcaatcagaaacccggctgcgtcaagtttggccataataagcattcgccccgtgttttctgtaaaaatgcttatcatgcagcactctgtcgatcggactgagctgtttgttcagcataagcgaatggtaggccatttccgctaccgtttcgagcacaacggcgttatgcagggcattcagcgcgtccgttccccagcagaacgggccgtggctgtggacgaggacacccggattttgttcatacggttcgttttgaaaggtttcggctataactttgcctgtatgatactcgtaatctttcacaatttcttcttcatacatttccctcgtgcagggtatagcgctttcaaagtaatccgcgtgagtcgttccgagagcgggtatgtctcttccggactgcgcccagctcgtcgcccagcgggagtgagtatgaacgattccgccgatagccggaaacgctttatacagataaagatgggtcggcgtgtcagaagacggtttcagcgagccttccaaaatgtctccgtcctcattcaggacgaccagcttgtcagcggtcagctcactgtaatcgacaccgctcggtttaatgacgattctcccgctctctctgtcaatgccgctgacattcccccatgtaaacgtgacaaggttatgttcctcaagcttcagattggcggcgagcacttcttcttttaacgcttcaagcatggcggctcccccctttcgcaaaatcacggtttttaatggctttcaggcgtttcatgacattgttttctttgccgaagtagtgtacgagctctttatattccgcatataagctgtcataaatctcagctctttcccggttcggggcataaaagccgtcttttaatttccccatatgcgcgcaagcttcagcaatattggagaatcctccgttttcccgtcccgcggcgagcgctccgaaaatcgcggagcccagtgcaggcgcctgcggagatccggataattgaatgtccatatttgtgacgtctgcgtaaatctgcatgacaaacggatttttttcggcgattcctccggctgcgtaaagctcctcgaccggaacgccgttttcccggaacgtttcgataatcatcctcgttccgaacgccgtcgcttcaatcaatgccctgtagatttcttcgggcttcgtgtgcagcgtcatgccgagcatcatgcccgtcaaatcggcgtccaccaaggttgaccggtttccgttccaccagtcaagcgcgagaaggccgctttccccgggaacaagttctgctgcttttttgctgagcagctcgtgaatgtctatgtgtttatcctcagcttccttctcatagtctctcggaacgcacgttttgacgaaccattcaaagtggtcgccgacacaggactgccccgcttcatatcccgcatatccgggcaaaatgccgttattgacgaccccgcacataccggggacgatatgttcttcctcgccgagcagcacatggcaggtagacgttcccatgatcatcagcattttccccggctctgtaataccgaccgcgggcactgacacatgagcgtcgacattggcgacggcaacggccgtccccggcagaagcccggtcagctccgccattttttcggtcaaacctcctgctttttccccgactgaataaatcgcgccgcttaatttatcctgtgtaatcgttttcattaacgggttgagcttttcgaaaaaatgatccggcggataccccgtctcctcattccagattgctttgtagccggccgtgcagttgcttcgcttcaatgaaccgcacaattgatagacgatccagtctgccgcttccacaatccgatctgccgccttgtatatatgcggcgcttcttccgcgatttgcatgattttcgggatcatccattcagaagaaattttaccgccgtatcttttaaggaatgtttcttttgtgtcttcggcaatcgtgttcaaacggtctgcatgtttttgagccgcatgatgcttccacagcttcacataactgtggggctcccgttcaaattccggcagcatacaaagcggctgccccgcgccgtctatcggtaaaatcgtgcaggcggtgaaatcaattcctatgccgatcacgtcttttggatcagcgcccgcctgctcaagcaggttcggaatcgccgtttccagaacttcgatataatcggcaggatgctgaagcgcccagtcccgagggagtttttcacccgtcttcggcagcgtgcggtcgatgacggcatgagtgtattcttttaccgcagacgcgatttcttcgcccgtgcggacattgacaagcaccgcccggccggacaatgtgccgaaatcaacaccaatcgtatacgccatatcaattccctcccagccggtataatacgtcattccatttcagctcttttttcagctcatgtatttcagtattgcgggaaataaagatgctttcaatgcctgccatctcagcccagtcaagcatctgttcagccgtaagccggaaggacatacaggtatggtgggcgcctcccgccagaatccatgcttccgcagctgttttcagcgatggctccggcttccacagcacccgcgccacagggagattcggcatatcatgatcaatttccctgccttccgcttcattcagaatgagacggaaccgcccgccgatatcaatgatgctggcgatgatggctgaaccgccgattccgttaaaaaccagccgggccggatcttccttccctccgattgagagcggatggacttcgattttcggctgatcaagggcgatcgtcggacatacttcaagcatatgtgatccgagaatcatcgcacgacccggttcaaaatggtacgtataatcttccatgaaggaggtttgttctccgtccgccattattttcatcattcgcacaagggcagccgttttccaatcgccttcgccggcaaatccgtaccctttttccatgagacgctgaacggcaagacccggaagctgcttcattccgtgcaaaacttcaaaggaggtcgaaaacgctgtatatccgccccgttcgagaaaggccgttaatccgagttcaattttcgcctgttctttaatggaagcaacttttgcttcatcccgcttcgtttcgtcgctgatgacatacaatttgtcgtattcctcataaagcgcctcaatttctgcgtcggtgacattgttcatcacctcggtaagatcgccgattccgtacccgtcaacctgccagccgaattgaatgtgggcgccgactttgtctccgtcagtaaccgccacattccgcatattgtcgccgaaccgggctactttaatattcctgctttcattccaagcggcagccgtgttcatccattgcgaaatgtcatgtttgacttcctcatcatcccaatagcctgcgatgacttttctcgtctgccccattcttgactggatatatccgtactcccggtctccgtgagcggattggttgctgttcataaagtccatatcaatcgtttcccacgggatgtcgcgatgatactgggtatgcagatgaagcatcggcttttgaaaagcggaaagaccttcaatccacattttcgcaggggaaaatgtatgcatccacgtcacgaccccggcacagttttcttgatactgcgcttcccgcaaaacctctctgatcgtttcagatgacgtgacaaccggtttatgcctgatcttgtatcttgatgacaccccgctgagaccgtcacatattccctttgcgtgtttatcgacaagctgcagcgtttcctctccgtataagtgctggcttcccgttacaaaccaaaattcatattctttgttctgaagcacattcatttccccttcccatcaaaataaagcgcttgcatttttaaataaatatacgtacgaatataaataataaaacttttattcttttatttgtacgaacaactttattatagttaaggaggaatcaaactgtcaatcttttattgcaagtaaaaaagccggacacacatgcccggctgatcaattaataggaaggccagcctgaactccaatcgatatcattgatgagcatcttcggaattccgctgttttcggcatcatacgcatgacgcactaaaatattcccgttcacaatgtcttgaccgcccgggcctttccagcggtcattgccggaatcaagaatcgtccctccgccttcagacatgcttttcccgcttttatcgagatatgggccggtgatgcttttggatcttccataagcgattttgtacgtactattcaccctgaacagcatttatcaaacgacaccattaagtaatagtagccgttctggtaggtgatggccggcgcttccaaagctccgccgttattcggtctggcagcgatggaataaagtgatcccgtcggtttcattgtatttttatcaagctttgtcagcttaatgccgctccaaaaagaaccgaaggcaagccaagggtttccgtctttatcaattgtcagctccggatcaattgcattgtagttattggcgcttgtcgaacggatgacaagcccttcgtccttccagtttcccgaactgaggcttgtagatgatgcaagaccgatcgcggaggtatttttgccgaatgaagaaacggcataatacagccaatactttccgttaaaatattgaacatcgggggcccattgattcagcccgtaattcggcacataattgccccaccatgacagcggggaagtaaagattgatttctgaacggtccatacgccgccgctgcccgcctttaagacgcgaagccccctctccccttccaaaccggttccgaaagcgtaccacgtgtttccttccttcgccattgtcggatcgtgaagcaattcatttgatgccccccaaaacgcggcagatgccggagatgaagacatcagaagcagaccggctgtaacgactgcgcatgaaaagcggatcatgcgtctgaatctgtttttcatttgtaaacctccctttttttaaagcgctttcaaaaacatgttgtcagatttttctatgtcttttcttattgtagacgcaaggctcatatttgtacagacaaaaaaaaaagaatctgcttaaaaaagcagattcttccgtatctttattgataagtaatacggtcaaccgtttcccggtctaattttttaattacttctgtgatcaattttaccgtattctcataatcatcccgatgcaaaatagcggcatgagtgtgaatgtagcgcgtcgcgatcgtaatggacagcgccggcactccgtttgcggttaaatgaatagaacctgaatccgtgccccctccggcaatggaatcgaattgatacggaattcccgcttcttccgccgtgtttacgacaaggtcgcgcagccctttgtgagataccattgacgcgtcatacagaataatttgcggcccttcgccgattttgctttgcgcctctttttcagaaattcccggtgtatctccggcaattccgacatccacaccgaacgcgatatcaggctggatcgtatgtgccgctgttttcgccccgcgcagcccgacttcttcttgaaccgttccgaccccgtatacttcattcgggtgatcactgtttttcagattttttaatacatcgatggcaatcgcacagccgatacggttgtcccacgctttcgccaataaatgcttttcattgttcatcactgtaaattcaaaatacggcacaatctgatcacccggaagaacgccccattccattgcttcttcacggctggacgccccgatatcgatgaacatctctttaatatcagcggctttttttctggcgtcaggaggcagaatgtgaggcggtttcgaaccgatgatccccgtgatgtcccctttttttgtcacgacggtgacgcgctgggccagcatgacctgagaccaccagccgccgacggtttgaaagcggagaaagcctttatcagtgatttgcgtcaccataaaaccgacttcgtctaaatgccctgagatcatgattttcggaccgttttctttgccggtttttttggcgattaaacttcccagccggtctgttgtgacatcatcggcaaatggttctatgtatgatttcatcacttgtcttacttctctctcatttcccggtatcccttttgcatccgttaacgctttcagcatggtgagcgtttcatctaattttgtcatcaataaacctcctttttttcactacccttcttattatacaaaaccaatgctgaagcatacgattaattcgcctgaaaaacgggtaaatgtttttatctatttcttttaaaaaaatgaaactttttgttttgtttttcgtattacatcagatcatgacaaaggtgaggaggtgccttcacacatatggccattacagtattgaggattgtcttgcttgcacttcttatttattttatttacatgtgcgtcaaattttacgcaaacccgaaaagaaggctcagactggcgcaatcaaaagagaatttttattttattgacgaacagaaaaacacgcgaaaaaatctccagcttacttataaaggagtgctctttgaaggagaaaagcatatcccttccaaagatcatccgctgtttatccatacaatatttgtatggaccgaaaatccggaaaagctgaaccgcttttctgcagatgattttgaagaagtcgaaaaaaaggtattggagcggtatccgaattgcaagattgattgggaccagcccatcaaaaaagcgaaaaaagcaggcgagcgataagctctcctgctttttattttttatacatcaaatacatgagcacaagggcggcttcagtgagaaaaagcagcggcaccccgtataaaaaggatttgtgcttcgtcttatgcctgaaggtgcgcatgccgatccatacgccgagtgagccgaacatggcggctgtgagccatattcgtttctctgatattctccacctgtgcgcctttgctcttcttttatcagcgcccatgatccaaaagccgtatccgtttatcaatacggcgtaaatgaagagagccattgattgtcaccctttacgtaaaaaaaccgctcccggaaagagagcggctttttcaacttacttgtctaactgagctttagcagcatcagcaagctgattgaaagcagtaagatcgtttacagcaagatcagcaagcattttgcggtttacttcgatgcctgaaagcttaagaccgtgcattaaacggctgtaagaaagaccgttcatacgtgcagcagcgttgatacgagtgatccaaagcttacggaaatcacgttttttctgacggcggtcacggaatgcatagtttcctgatttcatgacctgctggtttgctactttgtataatgtatgttttgaaccgaaataaccttttgctaatttaagaacctttttacgacgcttacgtgtaacagttccgccttttactcttggcattagatttccctcctaattgttccttgtccgattacttgatgttggcaagctgttgtttgatgcgtttgaagtctcctgcgctcacaatagcacccttgcgaagcttacgcttttgcttttgggatttgttggcgaataagtgacttgtgtatgcatgagaacgttttaacttcccagaacctgtctttttaaaacgtttagcagatccgcggtgagttttcatttttggcatgggatttcctccttattgcttttcgtttttcggcgcgagcattaagaacatgctgcggccgtccatttttggttttgtttcgactgtcgcaacttccgcacatgcttcagagaaacggtccaatacgcgctggccgatttctttatgagtgattgcgcgccctttaaagcggatagaagctttcactttatcgcctttttcaaggaatttaatcgcattgcgcaatttcgtgttaaagtcatgctcatcgatcgtcggacttaatctaacttcttttaagttaatgattttttgatttttgcgtgcttctttgtcctttttctgctgctcgaatcggaacttaccgtagtccatgatgcggcagacaggcggttttgcatttgctgcaactaacacaaggtcaagatttgcgcggccggcgatttcaagtgcttcctgacgggacttgatgccgagctgatcgccattttgtccgatcagacgaacttcacgtgcacggataccctcattaaccaattgatctttgctaataatgagccacctccatagtttcttcgaattgattcacaacgctttttgactgcattctgcaggcaaacaaaaagtgcgggcatgacaacacacccacactacgaacatctgcataaataaaaatgtacggtcaacctgccaactacatgaatgtgtcaatcaggtgagaagcgggtgcctctgcttgtgatttatattcaattcaataactattctacacaataccggatcattagtcaagaatgacttctccggatcaactttttcattttaacacgatgccggggtgagcgcaaggaaaaatgtgaaatttcgttctttgccgcccgcggacgtgccaacacaataaaaaacccgggtctatgacccgggtttatcctccgatgagctgaacgaataccggaatgaccagcaccgtcaccactcctacgacgacaaccgcgatacttgccattgccgcttctacttcccccatctcaatgccgaccgcaacaccgagtgcgtgtcctgatgtgccgagagccagtcccttagagattgggtgctttactttaaacagttttaagaataaagcgccaagagcatagacgataacggcgttgaaaataacggcgaaagcggtgatgtcggtgatgccgccgatcccttttgacagcggaagggcaattgccgttgtcgccgcctgcggaagcatgcttttcataacggccgcgtcgagatgaatgccttttgcgatcaaatagacaatcgtgactgagcagatagagccgacaatgatggaagacatgatctgccaccagtattttttcagcttggcacgctgtttgtataaagggatggcaaaagcgatcgtcgcgggctccaggaagaatttaataatgtctcctccgcttttataatcttcatacgaaaaaccgccgagcttcagaaaaagaattccaagcaccatcgcaacaaacagcggggtgaagaggaaaaagcctctcgtttttttaaataaatacgtgccgatgccaaaggccgcaagtgaaacgacaataccgaaatatggactcatccgttttccctcctaatgctgcacaagttcgttttcctgattggaacggcgcaccgtttgtttatcagccggagcagccttctgacgtttttggctgacagacaagatcagctgagaaaaaaggcctgtcgcccctaacagaatgatggtggcgagtaagatgacgagtgcgatctgcacgccgtactgctgcatgacgccaagtgaattcatcacggagatgcccgacgggacaaataaaaatccgatcagtgacgttaatgatgttcccagcgtttctacttgttcaagcttaatcactttcaggcataagaggacaaataataacaccaaacctactacggaagcgggtataggaatggggacaatcgctgcaatcccattagatatgagcataactacggcaaaaataaatgcttgtgtcagaaatccgtacacttttttcgcactcattttcttcacctctttctctttgttaggtccattataaaagagaaatcgatttttaaagcgctttcataacaaacggctgaatattcattctgaaatgcaaaaaacggctgctgaaatgcaaaagccgcctcatataatatgaagcagcttttttaagtccttggcgtatgtacggctgacgggaattttagaaccgtcttttaatatcagattgtaagtcgaattaaaccacggatgaatttccgtaatatgctccgtattcacgatgaacgcgcggtgcactctcaagaaacccgtatcaggcagttttttctcaatgaccgccaaagtttcatgaacggaataagacgcggcaaacgttttgacggaaacgtgtccgtcctccatgccggcgtaaataatgtccttcgtatctaaaatgacaatagattcaccggctgatacagccagtttatgcgctccggctgcggacggcagctccgagacggctcctgccctgtcctgcttcactcttttaaactttctgatcgtctggcgcactctttcttcatcaaaaggcttcgttaaataatcgagtgcgtcgacttcaaaagcttttaaagcaaattggtcatacgccgtcgcaaaaacgacggccggcggatttttcatgtttttcagccgtttggcaatatcaaatccgttttctcctgacaaatcaacgtccaaaaacagcagatccggtttttgatccatcatactgtcaaaagcggattcaatattttcagcttcgtttatgtcacttacttcattcgtccgtttcagcaaataagctaattcatctcttgccagcatttcatcatcaacgattaacaccttcagcatgttcttctcctttagtcatcagtttcaaaggcagctcaaatgatacgtccgtacctttgccggcctcactttccaatcgcagggctgccttggggccgaacagcccgatcagccgctgatttaaattgtaaagcgcggttcccgtcccttctttagacgggagcggacggtttccgagcacggacagcaattccggatcaattccccgcccgttatctccaacccgcattaaaaccgactgaccggcggataccacgctcacattgacggcacagctgtcctgctttcttgaaaatgcatggcgaagcgcattttcgacgagaatctgcagcacaaaaggaggaatttcgatgtcctccaaaccgcgttcgatttcaaggctgattttatatttcccaggaaaacgggcctgctccaatgataaatacgcctgcagatggttcagttctttagaaagcgggatgagcagctgccttgccccctggagattggaacggaaatagacgctgagctgcagcagaagctttcgggttttttctacatccgtacggcaaagagcagaaatcgtattgatcgcattaaacagaaaatgcggattgacctgtgcttgaagcgcttttatttctgcgtctttcagcaatttgctctgcagttccgcctcgccgagttcaagctgtgtggaaaacagcatggcgagtccttctgcaagctcttcttcaacccggcttaaacctgacgggcttttaaagtacattttcagcgtcccgatcgttttgccgtttgacgtcagcggcaatacaatcgccgcatgcagcggacagggatcgtgcgtgcattcaatttcttcctttgatgtcgctttcataatatgacccgttttaataacgcgctttgacaatccggtaatcaggctttcagacggaatatgatggtcggcacccgcgccgacgtgcgccaaaatcttttcgttatccgtaagcgataccgcgtccgttcctgtttgcctgtgaatgatggcggcgacgcttttgcatgagctttcattcagcccctggcggaaatacggaagcgtctgatcggcaatcatcagcaccctgtgggtttcaagggctctcgcccgttcttccttccggataatcgactgaatgatcgaaagaaaaataaaagtccctgacccgtttaccaatatcatcgggatgccgatgatgctcacaagcgtccaagcgtcagaaaacggcttggccatcaagaggatgagcagcatttgcagcgattccatcccgagtccgacaagcgcggccacacgcggtgtcggcatcctgtagcgttttctgaaataccgtccgatccagccggacaaaatgcccgctaaaacggatgagacggcacagctgactgcggtcgcgccgccgagtgataaacgatgcaggccggccagtatgccgacgccgatccccacataggggccgcctaagagtccgccgatttcaacgcccataattcttgtattggcaattgaaccggacggattaatttgaaacacccagtcattattcatgattgtattctgctgaatttctattcccgtatagttgctgatgatactgaacagcgagaaaattgaaatcagcaccgctttgcctttatagctctcaggctgctggagcgcctgtctgaacaatctggtatgagccagaacaaatcccaatatgacgataattccgactctttccagcatcatgatgatcaaatgcagcatacttttcacctgttctttcaaattttattttatcacgttttagagcccgagacagaatctgacacaaacctgcctgtttttttcaaatcatctgaaaacaaatctttcacagtctatgtatctattgtagaataaacgggagccttgcggcagagagtttcagaatataacaaagaggagaagatcatgaaagccgtattttttgatttggacgatacactgttatgggatgaaaaaagcgtcagaacaacattcagggaaacatgtttacaagcggaaaaaaaatatggccttgacccgcaaacatttgaagaggcggtacggaaagcggcacgggaattgtatatgtcatacgaaacctatccttatacggtcatgatcggcattaatccgtttgaaggattatgggcgaatttttccgagccggtcagcgaaggatttaaacagctgaatcggattgcgccggaatacagacgaaacgcctggacgaacggcttaaaaagcgtcggtatagacgatgcggcttacggcgaatatttggcggagtttttcgcggcggaacgcagacagcgcccgtatgtgtatgatgaaacgtttgcggtgcttgataagctgaaaggtgtttatgaattgcttctgctgacaaacggcgatcccagcctgcagaaagaaaaactagccggcgttcctgagctcgcgccttattttaatgaaatcgtcatctcaggcgctttcggaaaagggaaacccgatgcctccatattcgaacattgcctcggcctcctgaacctgaaaaaagaagacgccattatggtcggagataacctcaatactgatatattgggagcgaaacgggcaggcattacgacagtctgggtaaaccggacacaaaagaaaaatgatacggacattgcgcctgattacgtgatcagcgatcttcacgagctgtttgcgattatagagaaacaaaaagaaagataattttatacgcaaaaaaaccccattctgaatgaacggggttttttgtatttccggttattttttcgcttctgctacagcctttttcacaaaatcgtccaatgagacggtttctgatttctgctcgccgtatttccggacgtttaccgcgccgttttccgcttcttggtcaccgaccacaagcatgtacgggattttttgcatttgcgcttcacggattttatagccgattttttcgtcccggctgtcaagctcgacacgcaggccttcgcgctgcaggcgctcctgcacttttttcgcgtagtcaagatgcacggacggtgatacaggaatgacttggaattgcaccggcgcaagccatgtcggaagggcgcctttgtgctcttcgattaagaaagcaacgaaacgctccatcgttgatacgacgccgcggtgaataacgacagggcggtgctgtttgccgtcttctccgacgtaagtgagatcaaagcgttccggaagaaggaagtcaagctgtacagttgacaatgtctcttctttgccgatcgccgttttcacctgcacgtcaagtttagggccgtaaaacgccgcttcgccttccgcttcataatagtcgtgccccatctcatccattgccgccttcagcatggattgcgctttgttccacatctcatcatcatcaaaatatttttccgtatcttcaggatcgcggtaagacaggcggaatgtgtaatcactcagtccgaagtcttcgtatacgtcttgaatcaaacggacggtgcggatgaattcttctttaatctgatcagggcggacgaaaatgtgcgcgtcatttaacgtcatgccgcgtacgcgctgaagacctgaaagcgccccggacatttcataacgatgcatcgttccgagctcggcgatgcggatcggaagctcgcggtagctgtgaatgtcctgtttgtaaatcatcatatggtgaggacagttcatcggacggagcacgagtgtttcattgtccatttccatcggagggaacattgtatcctgataatgatcccagtgccctgatgtttcgtacaggtctttgcttccgaggacaggcgtatacacatgctcataaccgaggctcagctctttatccacaatgtagcgctcgatcacgcggcggatggtcgcgcctttcggcagccagagcggcagaccttgtccgactttttgagagttggcaaacaattttaattctttgcccagttttcggtggtcacgctctttcgcttcttcaagcatgcgcaaatgctctttcaagtcatcctttttaaagaaagccgtgccgtaaatccgctgaagcatttggtttttgctgtcgccgcgccagtatgcgcccgcaaggctcagcagcttaaattctttaattttgcctgtagacggcacgtgcacgccgcggcacaggtcaaaaaattcgccctgctcataaatagagaccgtttcgtcttctggaatcgcatccagcagttcaagcttcagattatcgccgatttccgcaaacatggcttttgcttcatcacggctcacttcttttcggatgatcggcagattttcaccgatgatgcgtttcatttctttttcaatcttcggaaggtcatccggcgtcagcgcctgctccatttcaacgtcataatagaacccgttttcaatgacggggccgactccgaatttcacatctttataaatgcgtttaatcgcctgggccaataaatgcgccgtgctgtgccgcatgatgttcaaaccttcttctgtgccttctgtaatgatttctacggcaccgtcctcttgaatcggcgttcttaaatcaatttcctgtccgttcagttttccggctaaagactttttctttaatcccggactgatggatgccgcgatatcttctgttgtagttcctttcggaaattcctttaccgctccgtccggaaatgtgatgttgatcatatctgacatcttcgtcactcctttttttatgcaaatcaaaaaccccgccccctatgaaagggacgaggttaaataaacggaatcgtggttccacccttttttccgcgcggccgattgcttcggcactgcggctctaagctctgtaacgggagttcccgtcagctattactggcgcttattccggcgttcacagctgaagttcaaaggcggtaaagacaatgatccatagctggaaagctttcagcctgggctctcctctcttatacagccggtatcaatgcttcatgtccttatcaatacgtgtagcaatcattaatcttttatgtattataaaatgtctgtgagaaaaatgcaactcggttttccgtctgatttcgcacagacagccctgccgcttacacaaggccgtccgtgcggctatccttccgtcttctcggctgcaaacgcgcccagcggaaaaaggcgcaccctctcctgaaacacgttttgaatggttcttgacatcatatgttccggtttgtccgtatacagttcgaccgtctcaggcgcaatggagatcagcggcgcaaggagatgggaatctatatacatcgggtgctcccgcacaaaccgtctgtctatgtattttttctgttcccgttcagacacatagcgcagctcccacagcgtaaaagcccggtcatgtacgatgcggactttcttcatccgcggcggattggatgtcacataatctctcagagactggataaagttttgatattcctgttccatccggtattcatctatcgcggcctccgtatattctctgagcctctcataatacctgccgagccggaacgtctgaaacgaacgcacggaaaaaacacccgcatcaagtgaaatcgttcggagcgcatctgaaataaactgtgtgcgcggctctttcttcggctcaaacggatgatcctcaagctctccttccataatgctgtgtgcaagctgaaggatttgctgctgttcatcctgatcggtgaagcagtatgcgtcctcaataagcgaaagcatatgctcgtcttctttgcattccaaaaaaaacctgacaagtatcggctcaataaagcgctgaacgcaaaaagccgtttcagaccttgcgattccgactttttttatgccttcacggacaataaaatgtctccggtcgtccgattgctgaatgagatgtaaaaaagcggcggtatcgtggtcatcttcaaagatcacttcaagcatatttgtccccccttacggcatctgttacaagtatatgggggatgtttttaaaatagacgtaaaggttagctttcaccgccgaacaaatgacgcaccttctttttaaatataacgggaagcgataaaaatacgacgtaaagacagatcacgcagagtacggccagcacattgccggacataaagctcgcgccgagcacattcaggacgatcgtccccggaatgatgcccgctgcggtcgccaaaaaatacgttaccggcctgactttcgataggcccgcggcatagctgatcacatcaaagttaacaggcagaatgcgcaggataaaaatataaaagaagccattggttttcatctgcttttgaatggcttccatttttccatgacggcttttctcattaaaggcaaacagccccgccgcaaaaaaagacgcggcggcagcgcccattgagcccgccagcgtatacatggtgccgaaaaacgggccgaacgccaatcctccggcgacggaaacgattgatacgggaaacagcacaaaaggcctgacgatggaaattccgataaacacaagcggcgcaaaaacaccgaacgataacacccacagccggatctccttaggcgacagattcagatatttgcggtttgcccacagcaaaagacccgctcccgccgcagccgcagcccaagtgacagccttcttattcctcattccctcaaatccttcccattggacgccggcatcatgaacggcggcggttttccccgtcaagacggacgggcgaagccaaatataaaatccgctccatcagtcttgccgcttttacttcttccttttctccccgctgtgaatacgtaaaatgatgcttcagctcgtctggtgaaaaattagacgagaagaaagtgggaagctgctggctcattctgtgctgaagcacggtgccgatgacttcatccctgacccagcttgtcattgactccgctccgatgtcatcaagcatcagtacgggcgtcgttttcaccatattcagtttcgcctccagcgactgatcctgaagcgagtttttcagctctctgacaaattcgggaacatatacgatcattgatgaatactctttttccgccagttcattggcaatggcggctaaaataaatgtctttccgattccgaattttccgtacagatacagccctttgccttttcccgtttcattatagctcttcagaaaatccgtcacatgctggaaaatgccgagtctgctcggatcggtaatgtcgatctgctgaaacgtcgcgccgagaagatcctgctggatatacatgctcttcatcagggacttttgccttttctggcggtcgagctttctcttttccggacattcgtaatattcaatatcaatggaacgcccgttgatcacaagcttcggatggtagccttcaagcaggctgttcgtccggctgtctttcgaacagaaggcgcactgtttactttgctgaacgaattcgtacagtttatttaaccctctgtcaatcatgctttgattgataacatctttctgttccttcaaaaaagcctggacgtcttcgtcggccataacttgctgctgcattcgttccaggcgtttttgaaagtcaggtcttttcgtcacgccttctaaggatcggctgatcggttccattcaatatcaccccgcttctctgtctcaataggcagagtattttttcagttttttcatttcttccatcatttttttcttctgttcttcaagatcctgtgcggaaagagccgtctgttcttgtttcttcccggtttcttcttctttcatccaatcagggcgcttttcttcccggacggtttttttgccgcgcgccgcgccgtttgttttgccgtccgcccaatcaagatattgcctgtgctcttcgattgcgagcttcattgcttcccgtaccgttttgactttctttctggcccagtgggcggcgattttttggatatagtttttggacagcttcatatccgttttcagcatgacataataaatcagcacattggtgacgccgggctcaagcttttgttcgaacataatatcggcgataatctgcaggtcggcttttgacggctcggtcccgtccgcaatgtcctggagaagctttctcggtgatatggtctcaagctgtgcgatgagttcgccgttcaatgaatcgtccttttccgtccggttttctctcaaggtgacaggctgtgttttatcaatcagttcgggaagcttgccgcttctttcaatttggtaccagtcgctggccgctttcctcagcgcttcggccgttatcgtatcctgctcattaattgcggtcatgacgacgtgctgcatggagataggatctattccgtataaatatgaaagctttttaatgctctcccgcacatcctgtgtgattgatttgcgcggtatcatcgtttctgataaccccgccaaaaacagctcaaaatcaaacacttcctccgtcaccgtataggaaggcgcttgtccgacagacgccgtctcatagtcctcggggagcttcatcgcctcttccatatcaggcgtcattttccattcactcggctgaaaagaggcaaaagcgtgattaaacggacgggtaatttcccttgcgcccgcgccgacggaagggtgcgtgtaaaattgtctcagctgctggtatttcgttttaccgactctgttataaagaaagacattcagcatgccgtcttcaaaaaaatcattcggcctgagcgggggcagcagctcataaataaacatccgctctttttgctcggactcccggatatacactttcagcagtccgattccttcaagctttccctgttcatgatgaatcttttttaaatttgactgcatcatgcccatcagctgcctgtgcgtggattccgctccccacaagcggttctgctcaagctccccccataaggtcatataaagggagaatgcaaaagaaccgatcagcggctggtacagatgtgtcaaaacctgtctgtcgacatcctgaagaagcgaacggcttttgaccgtataaggatctacaggcaatacgtcattccaatagtcagccatgattctcaaaccttccgatatgtttctactctcattttacaccgtttctgcgatctatcaaatgccaattttgctcatgagaaaagagccagacacaatctcttagctctctcagcgttctttctttattaaatctttcaattcatcgataaacacgtttatatccttaaactgccggtagacggaggcaaagcggacataagacacctcatcgattttcgccaggcggtccattaccatttcaccgacaagttcgcttttgacttcagatacgccttggtttctcagctctttttcaatgtcaaagcacatgtcttccaatgttttcaaaggaacgggccttttttcacaagctttaattaacccgcgcagcattttttcacggctgaattcttcccggacgccttcttttttcacgacgatcagaggcatctcttcaaacttctcaaatgtagtgaagcggtaatggcaggcttcgcattcccgccttctgcggattgatttcccttcgtccgcaggccgtgaatcaagtacgcgggaaccgttatgctggcatgaaggacatttcaaattggatcagctcccatctgtttcgttgctgtaatgcggttcgcaagcttccggtaaatgcccgccaacgtttctaggatgagcctatttgttgggagagccgatagaccggccttatcttttctattttacaaaaaaaatgcttaaagaaaaagcaatgctgtttttttacattagaaaaggagcatcagcttcaaagcgcgtaatggctttttcagcttagctcccttgtgtttgcgttttgaaaattacagtactttcgcttgtgcctgtttaatctgtacaggccccattcctctcggtatttcaatgttttctcttgtatctgcatgtaatgcgtccgcaatgtaatccgcagccacattaggatccaggtctccacaagtataaacatcaatgcttgcatatccgtgttcaggaaaactgtgaatcgttaaatgtgactcagagataataacgactccgcttacgccttgcggtgcaaatttgtgaaatgcgacctcgcgcacttcagctcctgatttcaaagcagcatttacaaacgttttttcaataaaatccatgtcattgagcttatcaaaatcgcatccccacagctcggagatgacgtgacgccccattgtttccataatcatggacccccttaacaagaattaaaaaagtgaatttccgagaactgacccggccatttaccacgggggaaagttagtccggagaggtcctaaccctttaagtaattccgaagcagtcacgagcaagaagttcacgaaagatagtatactgtgtttaagtttattttgcaaggtgtgttttttgcgaatatgccgttaagggtttttttctaacaaatgtccatgatctttagtctacacagctgacgggtgtttcattcgcgcggcgacgtgacggataagatcaacgacccggcaggaatatccccattcattgtcataccaggcgagcacctttacttttcggtcttccatcaccatcgttgtcagtccgtcgatgatcgcagagtgtgaattcgtattataatccgaagaaacgagcggctcatccgaataatcaagaattccgtacatcgacgtttttgaggctctttggaaagcggcgttcacttgctcggccgacacatctgttttcagatcgcagacaaggtccactaatgacacattcggaacgggaacacgcaaagcgagaccgtgaagttttcctttcaaatgaggcagcacgagcgacagcgctttagcggcgcctgtagaagtcggaatgatggattctccgcacgctctcgccctccgcagatctttatgcggattgtcgatatttttttgatcattcgtgtaagcgtgaacagtcgtcatcagcccgctttcaatcccgaattcctgatcaagcactttgacgaccggcgcaagacagtttgtcgtgcaggatgcatttgaaataatgacatgttcatcgggattgaactgctcttcatttactcccatgacaatggtaacgtcttcatttttgcccggagccgttaaaatgacttttttcgcccctgcttcaatatggctcatcgctttttcttttgaattaaatttccccgttgcctctacgacgatgtctattccgcattctttccacggaagctctctcgggtcccggcgattgaacagcataatatgttttccgttgacgatcaggctgtcgtcggcggtctcaacttcttgatggtatttgccgtgaattgtgtcatactttatcaaatgagcaagcgtttccgggggatagcttgcattaatggctgttatttgaatttgatcatcttccattgcttttctgaacaccattcttccgattcttccaaacccgtttattgctacttttaccttcatgctcaggtcacccctttttaatatgccactctaatttacctttatttatatatagtataacacattaaaagaaatccgccagtacaacttgataaaaatccacccttataccgatcaatatgttgttcaatcggtttttttgcatataaaatgatttttcttccataaaaaaagcaggatcagcgtctcaggctgcctgcttttttcttatatttgtcccggttctttaaatttgtcattcaaaatgctgtcctctaaaacggaagacacctcgccgtaccgtttagcaatatgcatcgcgccccagtcacacagcgcatttaaaattctttccagactgtgcccgtattcactcagctcgtattccactttcggcggcacctgattgtacacgatccggttgatgacgccgtcagcttccagctcccgcaattgctgtgtcagcatcttctgggtgatgtccggcataagccgcttcaattcgcttgtccgttttttcccgcgcatgaggtggcagaggatcacacacttccattttccgccgatcacttcaagcgccgcctctacggatatattgtattttttcttcagcaacggtaattcctcctcatctataggaactaaaaagtgcctatggcacttaaaagtacgttcttttcaatgacacttctatcaatcataatgacatttgccggctgaaaaggaatgtactcttatacttatatcgtttacccggcatcatttcaaccatacattatcgtttaaggaggaaaacagatgtcttcacatcgccaaagctatttaccagcgctgctggcattagccgtcagcgcttttgcgatcggcacaaccgaatttatcagcgtcggactgctgccgcttatatctcaagatctgcatatacctgtgacaacggcgggacttaccgtttccatgtatgctctgggcgtgacattcggcgcgccggttttaacgtctctcacatccggcatgtcgcggaaaacactgctgctctgggtgatgttgatttttatcgccggaaatacactcgcagcgagcgcttcctcaatcggcgtcttactggcggcacgggtcatttcggctttttcccacggcattttcatgtcaatcggggcaacgatcgccgccaatatcgtgccggagcataaaagagcaagcgcgatttccattatgttcacggggctgacggtggctacggtgaccggcgttccgttcggcacctatctcggccagcaattcggatggagaatcgcatttgccgtgattgtggcggtaggaatcatcgcattcctcacaaacgcgcttctcgttccgtctcatttgcgcaaagggacgaaaaccgcattttccgagcaggtcaaactcgtcacaaacggccggttattgcttttatttattattacagcgttaggctacggcggaacgtttgtcgtgtttacgtatttatctccgcttcttcaggaggtaacgggttttcagaaagaaaccgtcgcggccatcctgctcatttacggaattgcgattgccatcggaaacatgattggcggccgtttatcaaaccggaatccgctgaaagccttgttttatatgttcattgtccaggcagctgtgctgtttgtcctgacttttaccgcgccgtttaaaacagccgggctgatcaccattattttcatggggctgttggcgtttatgaatgtgccggggcttcaggtatatgtcgtgatgctgagtgaacgttttgcgccaagcgccgttgatacagcatcagccttaaatatcgcggcatttaatgccggaatcgcgatcggctcgtttgccggcggaatcattacagactcaatcggaatcattcataccgcttggatcggggcgctgatggtgctcagcgcggtcgtattaaccggatggagcaggaagctggaaaagcgggatcgcactgcccttgaaaggaggtgagtttttcttcagcgcattttgatttttttcgacagacaaataataggaggaatatatacatgacaacacatttacaagcaaaagcaacattgcataacggagtagagatgccttggttcggcatcggagttttcaaagtagaggaaggcgcggaactcgtcaacgcggtgaaaacggcattggtgcacggctatcgcagcgttgataccgccgcgatttacggaaatgaagaaggtgtcggcgaagggatccgccaagggctgcaagaagcgggattaaaacgtgaagacatttttgtcacgtcaaaagtatggaatgccgatttaggatatgaagaaacgttaaaagcgtttgacacaagcttagaaaaactcggtttagattatttagatttatatttgatccattggcctgtcgaaggaaagtacatcgatgcgtggcgggcgctcgaaaccctctaccgggatggacgcattaaggcgatcggggtcagcaatttccaaattcaccacctgaaacatctcatgaaagaaacggaaatcaagccgatgatcaaccaggtggagtaccacccgcgcctgacacagaaagaactgcttgctttctgcactgaacaaggcattcagcttgaagcgtggtcgccattgatgcaagggcagctgcttgatcaccccgtattacaggagattgctgagaaatacggcaaatcagccgctcaagtgattttgcgctgggatttgcaaaacggtgtcatcaccattccgaaatcaactaaaaaacaccgtattgaagaaaatgcaaatgtctttgatttcgaactgtcagctgaagatatgaagcggattgatgatctgaacgaaaatctccgtgtcggtccggaccctgacaattttgatttttaaccagaaaaacaccgttcggctttccgaacggtgtttgtttatgcccagccgctcaatacttcctcaagctggtgctttgtatattcaagactgccgctgttatcaatgacggcgtcagctttttttgctttgtccgctaaaggcatttgcgacgttatccggctcatcgcttcttcttctgtcagggaattccgctccatcagccgtttgagctgaatgtctgccggtacggtgacgacgagcactttgccgacaagataatcaagcccgctttcatacaaaagcggtatatccaaaacgacgaactgctcttttctcgcaatggcttcatcccgctgtttcagcatttccgcacgcactgccggatgaacgatctgattcagcttcagacgcttctgttcgtcagtgaaaacgatagaaccgagtttttttctgtcaatatcgccattttccagcaggatgtcttttccgaatgcttccacaatttgtccgtaagccggcattcctttttccaccgcctgtttcgcgatgacatccgcatcaatgactgttatttttttgtcgatcagcatacgcgctaccgtgcttttgccgcttgcgatgcctcccgttaaaccgatgaccaagctcaaaaagcccactccttcttacattttccaaatcccgatgataatcagcaggactcccggcaaaaatgtcattttatctatccaattccaccttgaaagcaaatgccccgcgtttatgccgagtgaaacaaacagcgagctcatcaccccgacagtcacgctcatcataaccggagaaaagccgagaatggccgctcccagcccggcgccaaacgcgtcaatggataaggcgataccgagcagaagcgcctcgactccgttaatggttccggattgatcaatatcggcgctggtcggttttttcaaaatatgaatgacgatgccgagcgatttcacttcaagattaagcagcgttttttcatgcaataagtaatccggctctttagccggtttaaaaaattgccagatgacccatgcccctattccgattaagatcagcccgcccagtttctccgtgacggatacaggaaaaatctttgtcagaaaatggccgatcagcatggatataaacatcacagaggctgaacagcaggcgatcacggcaatcgctttgaacgggattttcatttttctcaaaccgtacgtaaacccgactgaaaaactgtccaagctgacagcaaaagccaaaagcagcaaagaaacaatctccatatccgtttctccctttctcttgatcggcaattgtgacatatgcctattgggtgaatcacaatatatatatggagaaaggtcatcaactgtgttagaaaaaagtcattctgctgccgcctgcttgaacagcttcagtttatgattttttttggcagcgggcgcaaaaatgagtgcccctcccgccgaccacgattttagaaatcatcgtgccgcacgttttgcacggttcatcctttttgccgtagacgtaatgtttgagctgaaacattccgatctccccttgagaattgatataagaccggacggtgctcccgcccgcgtcaatcgcttcctgaagggtgtctttaatttctgtatgaagcgtttttatctgcccgtccgacagactgttcgcttttgtttcaggatgaatacgcgcccggaataaagcttcatcgacataaatattgccgaggccgacgaccgctttttggtcgagcagggcggtttttaccgcgcggttcgtttttgcaagccgctcttttaaataagcggcggtaaatgcttcatcatcgggttcgggcccgagctgtgaaagcggtaatgcattccgttcctctcccggcgcaaacaaatgcatcgtgccgaatttccggacatcccggtagcggagctgtgttccgtccgtcatgtgaaacacgacgtgcacatgtttatcgtcaggctcatcggcctgatgaagaccgtatttcccctccatacgcaggtgtgacaccatgacataatgatccaaatggaaaagcaaaaactttccccttcttccgatggatcggatcgtttctcctgcaatctgccgcgcgaattcctccggctcggcgggttttttgatgatattcggccatctgatatccgccgattcaatcgttttccccttcacaagaccggtcagagtgcgccggaccgtttcaacttctggtaattccggcacaatcatcacttcctttttttctgtttattttgcatcgtaccaagacggccctgaagcataatccgccttcagcggcacgtctaatgccaaagcatgctccatcacttcaggaaccagcttctctaatatttcaatttcttccttaggcgcttcaaaaattaattcatcgtgcacctgaagcaacagtcgcgccttcaggtttttttctttcagctcagctgccatgtcaatcatggcttttttaataatatcggcggcgcttccctgaatcggcgtattcatggccgtccgttccgcaaagctccgcaggttgaagttgcggctggtcagctcagggatatagcggcggcgctgcataagtgtcgtcacatatcctttttgtttcgcttcctgcaccgattcttccatatacgccttgacgcccgggaagctctccaaatagcggtcaataaaagcgcccgcttctttccgggtgatgccgaggttttgcgacagcccgtaatcactgatgccgtaaacgatgccgaaattgacggcctttgcctggcggcgcatcgcttgtgtcacttcatcttcactgacatgaaacacgtccatggcggtttttgtgtgaatgtccatatcattcgtaaacgcttcgatcagattttcatcttttgaaatatgcgcaagcacccttaattcaatttgtgaataatcggcggcgaaaataagccagtccggttcggacggtacgaaagcctgacggattttccgcccttcctccagccggatcggaatattctgcaggttcggatccgttgagctgaggcgtccggtttgagtcaatgcctgattgaatcgtgtatgcaccttatgagaacccttgcgcgtgactttcagcagcccttcaatataagtcgattggagtttgccgatttgtctgtattgcagaatgtacgcgacgatatcatgtttgtctgcgagcttctcaagcacatcagctgaagtggaatagcctgtttttgttttctttactggcggcaggccgagtttttcaaacagaatgacgccgagctgttttggtgaattgatgttaaacggctcaccggcgatgtcatggattttttcttcatattctttcagttttgccttgagctcttctcccattcgcttcagtctttccacatccactttgacgcccattgattccatttctccgagaattagcgcaagcgggagttcaagatcttcataaagctcaagctgattattttcttccaaagcgtcaagcagtttgtcacggaggctgttaacggcagacgctttccgcgcgagatgatcggcaagctctttttcagcgggaacggcgcgttttgcgccttttccgtataccgcttcatcttttgaaacgatattcagcccgtattctttcgctacgctcgcgacatcgtcgtacgaattgcccgggtttataatgtaggcagcaagaagcgcgtcaaattccgttcccttcagctcaattccctgccagcgcaaagcgacgacggaacgtttgctgtcgaacacccactttttcatcgattcatcttcagcccaagatttaaaagcttcagactgaatggcgatttctttcggaatataataaagacctgtttcattcacgatggaaaagccgaggatcggttcttcgtgatagttatcaccgatttgttcgacgaccaaagcggacggcgaaacgagcatatcttcggtgatttcttctgctgtttcgacattgatgtcttcaaaattttcttccgccgtttccccgctttcttcaccgagccgctcaagaagcgtattaaaaccgaggtctttaaaaatggcaacaacttgttcacggtcaaacccttggtaatctaaatcttcgggcttgacttcaatcggcgcatttgtcataatcgtcgccagctctttgctcatcagggcttgttccttatattcttcaagcttttcttttaatttttttccgctgacttcatcaatggaatcaagcagtttctcaaccgaatggaactgctttaagagcttaatcgcggttttttctccgacgccggggacgcccggtatgttatcggatgaatctcccattaatcccttcatatcaatgatttgcaaaggagtcagaccgtacttttcccgcacgtgctccggcgtgtaatcttctacgtcggtaatgccttttctcgtaatggcaacggtcgttttcccggttgcaagctgggttaagtccttgtcccccgaaacgaccttcacttcaaagccgtctttttcagcagatacggcaagcgtgccgataatatcgtccgcttcatattcaggaagctcgtagcggctgatgttgtaggcatcgaggagctcgcggatgaacggcatctgttctgaaagctccggcggcgttttttgtcttccgcctttatattctttaaacgtgctgtggcggaaagtggtttttcccgcatcaaaagccaccagcatatgggtcggtttttcatcttccagcattttcattaaaatcatcgcaaacccgtatacggcatttgtatgaatgcctttttcattgcttaaaagcggcaatgcaaaaaacgcccggtacgccagactgtttccgtcgacaagcactaatttttttcgttccgtcattcaatatcctcctaagagcaaaagctcgtcattcctctgttttttaatctcacagcttctcttattttaacaaagttcaatttgaaaggaaaatgagcggaccccgtgaaaacgcaaaaaaggacgggaacaagaaaacgcgttcccgccgtcaaaattggctccttggatgaaggggttctgttatatcctaacaagataggtttaacaggtcatgaagaaattgttaatcctttgtaaagctgatcacgctgccggcggccgcttcagcgtcacagtgaacacagttccctgtccaggctcgcttgtgacctcgattttaccttcatgggcttctattaagtgcttcacaatggcgaggccgaggccggttcctcccgagttgcggcttctgtctttatccacgcggtagaatctctcaaatatccgcgggatctcttctttctgaatgccgattcccgtatcggacactttgatatcgacaacggtttctttcacatgtaccgaaatccccaccgtccctttttcaggcgtgtaggtcagggcattgttcgccagattcaaaaatacctgcttcagcctgtgcgcatcacccgtcacaaaaatcggctcttccgggagatcgagctgaaagctgatgcctttttcctcagccttatgctgcaaaagcgcctcaatttcatgcagaatttttgcagcatcaaaggactctacgcgcatcgtaaagttttgctgctccatcttggataaatccaataaatcctgcacgagagattggagccgctcactttctttcagaatgatagacagaaagtctgaaagcgccttttcgtctttcatcgctccgtctaacagtgtttccgtaaatcctttaatcgaggtgatcggtgttttcagttcatgggagacattggcgacgaagtcctttctcatctgctccaattttttaatttccgtcatatcgtgaaaaacgaggacgatgcccttccattcatcatcagggcccatgatcggaacgccgtcaacttcaaagtagcgccgctcaatgttgatgggaagtctgagcagctggcattttttcgtctccgtcataaaaatgtcttcgacaagccgaatgatctcctcatgttcaaacgcatcgtggtaaaggcgccgaagcagacgttcaggctttgtatgaaactgcttcgtgtatgaccggttcacgagattgataaaacctctcccgtctattaaaatcaaaccggatccgatattttcaatgacggttaacagacgatcgcgctgcatatcctgcgttcttgtcatttccattaaatcgaccgccaggctgttcatcgcacgcccgagacggtccgaccgccttgcgtaaccgctgtaggagcgggcgtcgtaattccctttggacagctccgtcgccacctttgtcgcggcgtcgattgattttttgtaacgcgacgtcatgtttgtataaaagaaaacgataatgataaaagcggtacaaagacttgctgccagcatgccccacatttctccggtaacgcttgaaccgccgttgatatccgaggaaacgagtacataccccgcaattttccctgcgtcattttttacggcagtgccgcggatgactctgcttttcgactgtacggcttcctcgcttttattgtgagaaatgaactcctttacggctgaatcatcagcacgactgccggaatgatatacggcgtcacccttctcgttgagcaaggagacgtttataccgagggtgcggccggcgtcacggattaccgtttcattgcttttattgccgattcggccggtgtcaagaaggcccgctatgtataccgattcctttttcagctgatccgccgttctttcttcagcggatgaagaaataagctgctgtaaaaaaaggccgagaacactgaaaaccaatatgatacatacaacgagtaaagcgaacagacgcacacggactttattcattcatttttggctcctccagtttataccccaaacctctgattgttttaatatagatgggttttttggtatttgattcgattttgtcgcgcagatggctgatatgaacgtcaacaatccgggtatccccggcaaaatcatagttccagaccgcgctcagcagaagatctctcgtcagcactcttcccttgtgttttcccaaatacagaagcagttcaaattctttaggcgtcaattccagctgttctgacttgaagtacgcttcgtaatgctccggaagaattttcagctcgccgatgaggatctgcccgtccttttcctcttctctgccttgtgacagcgaagaaatgtcagcccttcttaaaatggctttcacccgcgcagtgacttcccgcggactgaacggctttgtcatgtaatcatccgctccgagctccagtcccagcaccttatcaaattcctcatcttttgctgtcagcatcaagatcggaaccatcattttctgctgtctgagctgtttacagacgtcgattccgtccactttcggcagcatgacatccagtacgattaaatccggattttcattctctgccagctccagagcctcttcgccgtctgatgcggttatgacatcatagccggaccgttccagattatactgtaaaagagtaacgatagattgttcatcatctacaactaaaatttttttgttcatgctgcgccctccgctgtctattttccccgacatccaattttctctattttatgtgctgcatatcactttatgatttcattttatccaatactgcccgttcagacaattcgcctttttgatcattttcagagaaaggatcgctcagggaaaaagaaaacgctttcattaattgtaaaaagaggaaggcttctgattcggaagccttcccttttttcttatgacaatactttcatcacgtttttgacagattcaactgatttactcagctgcgctttttcatagtctgtcagttcaagctcgatgatttgctccaggccgtttcctccgataatcgtcggtacgcctaagtaaatgccttcatgaccgtattcgccttctaagtaagcgatggtcggaagcacgcggcgctgatctttcaaaatggcttctaccatttcagtcagtgatgcagcaggcgcgtagtaggcgcttccgtttccgagaaggttgacgatttccccgccgccttttcttgtgcgttctacaatcgcatcaagacggtctttcgggataagcgtttcaagcggaatgccgcccgcataggaataacggacgagaggaaccatgtcgtcaccgtgtccgccaagaacaaaaccggtcacatcttttacagacaggtttaattcttcagcgacgaatgttctgaatcgcgcagtgtcaagcactccggattgtccgatgacgcgttctttcgggaagcctgattctttgtacaccgcatatgtcatcgcatcaacagggtttgtcaatacaacgataatgcagtcaggagaatatttcacgatctcacgtgtgacgcttctcatgattttttcgtttgtagatacgagatcatcacggctcatgcctggttttctcgcaattccggctgtgatgacgacgatatcagaaccggctgtgtcctcgtagttggacgtgcctgtgattttcgcgtcaaatccttgaaccggacttgcttcgagcatgtctagcgcttttccttttgtcgggttttctaattgcggaatatcaacgagcacaacgtccgcaagctctttttgagctgtaagaaaggctgttgtcgctcccgtaaatcctgctccgataacagaaactttactgcgtgtttttcccatgattctcttctccttttttggcttcattagaagtctgctttaggttcagtccatgtttttgatgagctcttcaccgaactctgaacatttcacttcagttgcaccgtccattaatctagcaaaatcgtacgttactacttttgaagcaatcgttttttccatagatttaatgatcaagtcagcagcctcattccagttcaggtgttcaagaagaagcactcctgaaaggatgacggatgacgggttgaccttgtcaaggccggcatatttaggagccgttccgtgagtcgcttcgaaaatcgcatgccctgtttcatagttgatgttcgctcccggcgcgattccgattccgcctacctgagcggcaagcgcatcagagatatagtctccgtttaagttcattgtcgccacgacgtcgaattcgctcggacgggtcaagatctgctgaaggaaaatatcagcgatgctgtctttgacgatgatttttcctgccgcttccgcttcgctctgcgctttatcagccgcttcttttccgtctttttcgacaatgcggtcatattcagcccaagtgaatactttatctccgtattctctttcggcaagctcgtagccccagtttttaaatgccccttcagtgaacttcataatgtttcctttgtggacaagcgtgacagacttacggccgttttcgatcgcatactcaatggcagctctgactaagcggcttgtgccttcttcagaaacaggcttgatcccgattcctgacgtttcagggaaacggattttgttaacgcccatttcattttgcaggaagctgatcagcttttcaacttcttcagaacctttcgcatactcaattccggcgtaaatatcttccgtattctcgcggaaaatgaccatatccgtatcttcaggacgtttgaccggagaaggcactcccgtgaaatatctgacagggcgcaggcacgtaaacaaatcaagctcctgtctcagcgccacgttcagagaacggataccgccgccgaccggcgtcgtcagaggacctttgatggcgatgaagtactctctgatgtcttccagtgtttcggcaggaagccactcacctgttttattataagccttttcaccggcataaacttctttccacgtgatttttttctcgcctttatatgctttttcaacagcggcttccaatactttagaagcggcattccaaatatcagggcctgtgccgtcgccttcaataaacgggataatcggattatttggtacgtttaatactccattagagactgtaattttttcaccttgtgacacaatattacctcccagtatgtaattcatatttagaaaacattttatttttcttgtataaaaaataaaatgacttttctcaagattctatcaaaattgtaaaccaatccgggcttgattaacaagaggctaacgacatgaaaatcaccagcctcccgtttgatcaggctctttcatcaagcggaacaaaagtctgcttatccggacccgtgtaatcagcgcgcgggcggatgaggcggttgttatcgtattgttcaagaatatgggcgatccatcctgacattctgctgaccgcaaagatcggcgtgaacagatcgtgatcaatgccgagactgtggtagacagatgcggaatagaaatcaacgttaggcggaagttttttctccgacgtcacgatttcttcgacacggattgacatctcgtaccatttgctttcacccgtcagattcgtcaggcgtttgctcatttcttttaagtgtttggcgcgcgggtctccatgcttatacacacggtgtccgaagcccattactttttcctttttctccattttgctgcggatataaggctcggcgttttccacttcgccgatttctgtcagcattttcatgacggcttcattggctccgccgtgaagcggtccttttaaagcgccgattgcggcagtgatgcctgagtaaatatcagataaggtggcgacacatactctcgccgtaaatgttgatgcattcagctcatgatccgcatgaagaatgagcgctttgttaaacgcttccacttcgatcggagaaggctcttcaccgtttaaggtgtaaaggaagttctccgcgattccgtactcttccttcggttcaacaggatcaagtcctttgcggattcttgagaaagcggcgacaatgcccggcactttcgcctgcagacggatggcttttctgtagttcgcttccggattcatgacatcggcttcactgtcagtcagaccgagtaatgaaatcgccgtccggagcgcagccattggatgtacgttattgaggggataggatttgaagtgctcaatgatttcttgtggaacggcagcttctttcgcaagctgttttttcagttcagcaagttccgttttattcggcaggcgcagatgccacagcaaataaatgatttcttcaaaacttgcattctctgtcaagtcgtcaatatcgtaccctacatatgtaagggtatcgtcgataatagagcttacagatgatgttgttgctacaaccccttcaagaccgcgtgttgctgtcatattcaacctctccttttcaatcaaaattcccctttaaagagtatataaaacatacggcttacttaaaatgagtcatgcaaacaatccctttcccctttaagaaaatgcttacatttcactggttgcggttacataaccggtatgcttatagaggaacataacaaattcttataagcttatttaagtttaagcctattcttattataaacaataatctgattaatttgtagacttttaactaaaaatgttttaaaagccctatatatcaaggcttggcgttgataaatttaatcgcttgctttcagatgctttgtaaaaccatgtattctcatgttttcatttggggggagctttggggaaactttaaaaggacaggcgcaacaacttcaccgcaaatccctccttctttaccggagaaggggggattttgtttactcgactgaatcaatgttcggatcagcttcggaaatccatgtcttggttttagttggctccccgtacatggactggaatcgtttgactgcatttgcgctgttgtcggcccgtaaatatcctcatcaaaccgttcatcaattgaaactgactcatttactgatgtaggtgaagttaaataaatgcagaaaaaccctcctcatctcgagaagggctcgatttctgcttcttttttctaaatcagtccgaagaaaaaactgatgccgctcaactttttaatcgaagggcttcgggttctccaactatttgcccctatgcttttcttttgctttttgttttctgattaaatatttttgttcctttattttttctctttgttttctgttcagttgttttttcttttcttttcttgcttcaagctcctgttttatcgctttttgcgccttagttgatatcccgatatttttcatctctttagaagcttgccgttgtaatctttttgggtttaacttcttagattttgctttaacacaaacccctgtttgttcagtgcgggagagagtctgtaaaagttgattatgaacaaaatgcatgatttctgaatccttgggctcttttccaaacaaatgacgaactgctcttaatttcccatcattcacaacttcaatgactcctacccaaaactgaccatcgtagtaaaccgttaatttcataacgattccctcctcctaaatttactgaagaatgatggacatcccgaggaggggaaggttactgacattttaaataatgcatccggactaccaaccgaattgtgttttttcattctcattataaatttaacaaactttcaaattgaaggaaagggtctccgcttattttaacaacacttcaagttttgatttggttcaagtgcataaattccatcagcttttaatccattcatcaattggaaccgccttactgcatccgctgtcatcgcacaatatgcgccggcgattccgaagttctttgttacatggtaagccacttcattcctcggaataatgcaaatggcatttgtctgaactacaaaatgccctgcaaactcttattttcacccgcaaaaaaaagcagctttacgccgcttttttactttatgaagtgaatattttaacgatttgcatggccaagtaggcgattccggcgccgattaacgggccgacggcgacgcctccgaaaagcgcgacggcaagtatcgtgccgatgaccagcgccgttgtaatatgagggtcgttttccaataaggtgagaccgtttttggcgattaaggcaaccgcgatcccggcaccgagagcgatccacgcataatatgatttcatcgcttctccgagctgtttaaaaccgatatcacctgtggcaatcggcactaaaacggcgattgtaatgacggtgacccccagttgatgccttttgactgaataaccggaaatagtttctgatcaagaccgacagcttttatcacaatgagaaagccgacggcaaaaagcaatgactgatttttggctaccaatgcgatggccagcaataatagtaaaaataaattcgcctgtgtaaacatcctgaaagcaccctctttcatcatatctgtaatcatatccttttttttgacgaataaactaatgtaataggacgtgccgaccgagaggaggatcgatgtgaatccgcactatgcaactgtttttttccgcgcgctgtttgtactcgctgcggccggcggcgctttagcggccggttacgcctcatttccgttaacttatccgtttctgatcgcccttattctgtcatcagcgatcattcccgttgttgactggctggacaaactgacggggctgccccggtcagtcaatacagtcattgtcctggtcttctttttgcttattcttctcggcgcggcaacatttctcgttgcggaaatcatttcgggaaccgcctatctggccaaaacgctccctccccatatcagcgcctttatgacgtattgcgaagagctgttcacttcccgcattcagccattgtaccacgagctgaccgtcctatttaacgggctggaaaccaatcagcaggcttccatcgtgacgcatattcagaccctcggtgatacagccgctaaaaatgcggggctcatgctttcacatcttttggagctggtgccgaaatggattgccttccttcccaatacagctgccgtcttcattttcgcaatgctggcgactttttttatgacaaaggactggcataagctgaaggcgctgctttattccatttttccggaacgggtttcggcaaacgccaaggccgtatcgggagagctgaaaaaagcgatggcaggtttcattaaggcgcaggccgtgctcatacttttcacgatgatcattgtctttatcggactttttcttttagggattgagcatgcggcaaccatcgccttttttatcggcctggttgatctgctcccgtatctcggcgccgggtcggtctttgttccctggattatgtatttggccattgccggtcagcttcctcaagcgatcggtctcggtgttttatatattgtggttctcattcagcgccagctgacggagccgaaaattttaagcaagtcaatcggacttgatccgcttgcgaccttaatcgccctgtttgccggctttaaattgttcggaattttaggactggctgccgggcccgcgctgctcgttttcattcaggcctttatcacaacgggcgctctaaaagaaatatgggcctatattactgttcaatccaaataaaaacagcagccctgtaagaaggctgccgttttttatttgataatgatccgcttgttttttgacatccctctcagccatttgaacaaaaacggcttcatgcggttccgagtgaacggaatcagaagacaggcccctgcaatatcggacagaaaacccggaagcatcaaaagcaggcctccgaaaaagacgcatattccgtcaagaagcgcttcccccggcattttgccgtgctgcaggtcgcgcatcacccgatgatacacatcggttccctgtctttttgccaccaaagcgcctaacacgcctgtcaaaatgatgagaaggaaggtcggaaaaataccgagccattttcccgccagcagaaacaaaccgatttcaattgccggacatacgataaacagtaagaataacactctcatttttctgccctcctgcccttctaaaagcgcgtcaccgcccgcatgggaataggaaaatcaacctaaagacaaaagagaagggagaacccccctctcttttttaaagctgtttaaagaacgcttgcgcggccttcatacacagcgccgcgggcagcgtcaactgtgataacctgtccttctgttaaaactgaagttgcgttctcaaggccgacgataaccggaatgcccaagcttaaaccgacaacggctgcatggcttgtcagaccgccttcttcagtgatgagcgctgatgctttttcaagtgaagcgatcatgtcgcggtcagtgcttgaagcaaccaatactgcgccgtctgtcattttttgttcagcttctttcgcattttttgcaacaacgaccggaccgaatgcagatttgcgtccgatgccttgccctttcgcgataatgctgccgacagtgtggactttcatcagattcgtcgtgcctgattcaccgacagaacctgctgtaatgacaatcagatcaccgcgtttcacgatgccgctgtcaagtgatttttgaaccgcgtcttcaagcatttcatctgtagaattcgcgttttggccgcttgacgggaatacaccgaatacaaggccgagtttgcgtgatacagactcattaaccgtaacggctacaatcggagcctgcggacggtatttcgcgatcatacgcgccgtatggccgctttctgtaggcgtcacgatagctgccgcactcagattgatcgccgtgtgcgcaactgattggccgatcgcatcagtaatcgtcatgccgacctgatctctgcgtttagacagaatttctttatagttcagagattcttccgtgcgtgtggcgatgttaaacattgtttgaaccgcctcaacaggatattgtcccgcagccgtctcaccggaaagcatgatcgcatctgtgccgtcgaaaatggcgttggcaacgtcacttgcttcagcacgtgtcggacgagggttgcgctgcatgctgtctagcatttgtgtcgcagtaataaccggtttgcccagcgcgttgcattttttgatcatttctttttgcacgagcggcacttcttcggccggaatctctacgccgaggtctccgcgcgctaccattaggccgtcagatacttccaggatcgcatccaggttgtccacgccttcctggttctcgatcttaggaatgatttgaatgtcagacgcgttatgctcttcaagcagttcgcggatttccaggacatccgtagaacggcgtacaaatgacgcagcgatgaaatcaacgccttgctcgataccgaatatgatgtctttggcgtctttttcagtaattccgggaaggttgacgctgacgccgggaacgtttacgccttttttatttttcagcgtgccgctgtttaagatttttgttttgatttcgtgtttttccggatttgattccagcacttccaatccgattaaaccgtcatccagcaggatgatagaccctgctgacacgtcgtctgccaggccttcataagaaactgagaatttttcaagcgttcccagcacctgtttcgtagaaacgataatttcatttcccgcctgaagctcaagcgcgccgttttccatatcgtgcgtgcggatttccggacctttcgtatcgaggagaatccccacgtttttgccgagctttttgctggcttctctgatgtttttgattcttgcgccgtgctcttcgaaatcaccgtgtgaaaaattcagacgagcaacgttcatacccgcttccatcaattttgtcagcatttctacactttcactggccggaccgattgtacaaacgatttttgtttttttcaactcgttcacttccttctgaaatcttcagcttcttccgccttaaatagacagttcttttgaaagctgatacatgtttggttcaacagtatgttttgattctaaaatttctataatatcatggtctacaagcttgttgttttgtatacctacgcagcgtccgccttttcctttaagcagaagctcaaccgcgtaagcgccgaggcggcttgcaagaacccggtcagaagcgcttggagatccgccgcgctggatgtgccctaaaacggatacccgtgtttcaaggttcgtttcttcttcgatgcgttttccgaattcaaccccgctgcctaccccttctgcaacgatgatgatactgtgttttttgccgcggtcgtgccctctcttcaaacggccgataatttcctccatatcgtagtccgcttcaggaattaagattgattccgctccgcctgcaagacctgcccataaagcaatgtcgcccgcatggcgccccatcacttcaataacgtatgtacgctcatgagacgtagcggtgtcacggattttatcaatcgcatcaattacggtgtttaacgccgtatcaaatccgatcgtaaaatcagttcccgggatgtcattatctatcgtacccggtacacctacacacggaaacccgtgttccgttaattttttcgcacccatgtatgaaccgtctccgccgatgacgacaagaccttcaatgccgagtttctttaaattttcgattcctttttcacggccttcaactgttttgaattcaggacatctggccgtatacagctttgttccgccgcggtggatgatgtcaccgaccgaacccagctccagtttttctatttttccgctgattaatcctgaataaccgttataaattccgtacacttcgacgtcgtggtagatagctttccgcacaaccgcgcgcaccgcagcgttcatacccggggaatccccgccgctcgttaaaactcctatacgcttcatttcctattcacctcagcaactatatatgttaaacatatcatgatcattgccctaaaacaatgaaaagggacgcctgagctcccatgaaaccttacctattatacaattaaataaattgtttttaaataaaatttaaggaatatcacaaaaatcacaaaaaataaacgtgagccataggcttcacgtctattcagtttaccccgatatattgatcctcaaccgaaactttcccgattgctttatatttttcatagcgctgtgagatcaactcttcggcgttcaatcgaagaagagattttaacgtttctttaagaataccgtcaatgtagcccgcctgctgcttgatatcatggtgagctccgcccttcacttctttaatcatatcatcaataattcctaattctaataaatcgggcgcagtaatcttcatggtttcggccgcttttttcgcaaggctggagtctttccacaaaatggacgcggctccttcaggagaaataacggaatacgtcgagttctcaagcatcagcatgcggttgcccacacctaacgcaagcgcgcctccgctgccgccttccccgatgacgatacaaacgacaggcactgtcaggccggccatctcgaacaggttcttggcgatggcttcactttgtccccgttcctccgccgctttacccgggtacgctcctttcgtgtcgatgaagcagataatcgggcggttgaacttatccgcctgcttcatgagacgaagcgctttgcggtagccctcagggtgaggcatcccgaaattgcggacaaggttttctttcgtgtcttttccgcgctgatgtccgatgacggtgaccggcatgccgtgatatttggcgactccgccgacaatcgcagcatcatctccgtatgttctgtctccgtgacactcaaaaaagtcggtaaacaggtattgaatgtaatcaagcgtcgtcggccggtcgggaaggcgtgcgatctgcactctgtcccacggcttcagatttttataaatctcatcctggagcttgctgagccggtcttcaagccttgcgatttcagcgcttaaatccatctccgaatcttgggtgaattttttcagttcggcaattttcgtctgcagttcaatcaccggtttttcaaattctaatcttgcagccactcatgctcacctcctgtttggtgcatgtccagcagaaatgcgagtttctctttcatgtcgtttcggtgaatcaccgcatcaagctggccgtgctttaataaaaattccgccgtctggaaatcttccggcagtttttccccgatcgtctgttcaataatacgtcttcctgcaaatccgatcaaggcgcccggttcagcgaaattataatcaccgagagacgcgaaactggccgatacgccgcctgtcgtcgggtgggtcatgacagaaataatcagtccctgctcctcactgaacagttttaatgcagagcttgtctttgccatttgcataagacttaagaccccttcctgcatacgtgcgccgccggaagcggtaaagatgataaacgggactttttcctcttttgctttttcaattgcaagcgtgattttttcgccgacaaccgaacccatgctgcccattcggaatgttgaatccatgatcgcgatcacggcagggaatccgctgatggttccttttccggtaaccaccgcttcattcagcgatgttttctcacggtctttttcgattttttctaagtattccgggaaaccgagcgggttttcagatatcattccctggttgaattcttcgaatgaatcttcatccaggaggctttcaatgcgctgctttgcattcatcgggaaatggtgcccgcagttcatgcagacgcgcaggtttttatctaactcttttgtgagcatgatttttttacatttggggcactttgtcataatgccttccggaacatcatgttttgcctgctcagacggcacggaagcatattttttcttttttgtgaatatatcctttaacaaatgattacctcccttttgtgaagggttctcttcactgcatgtcttccgattagatagacttaataataactttaccgaaactattgtactttttttgtcaaacggtgtcatcctccattcgacattttttgctgcaaaacagacggaaacggacggatttcataccgtaaaaagcgttgttcagccttatctgtcagcgttttcaaaagaaataaggattctgctgaaatttttttaagacctgcccttaaaaaaatgccagcagtccgtatattgaacagcagcgcgttgttttttccaacgcgctgccatttcatttttgtgttattattccccgatgactgtgagctgtcttgttttttcagccacttcttcaggatcgaccgtaattctggcgacgcccgtttccatcgctgctttcgcaacagctttcgcaacggcaggagccacgcgtttgtcaaacggagccgggatgacataatcagcgcttaattcttcctctgaaacaagggaagcaatcgcttcaaccgcagcaattttcatttcttcgttgatgtgagtcgcgcgaacgtcaagcgccccgcggaaaattccagggaatgccagcacgttgttaacctggttcgggaaatcagaacggcctgttccgattacgctagcgccggctgcgcgcgcgtcttcaggcatgatttccggattcgggttggccattgcgaagataatcggatctttcgccatgctctccaccatttctttcgtcagcgcgccttcgactgatacgccgataaagacgtctgcatctttaatgacatcctgcagcgagccatcgttgcggtcttggtttgtaaacttggccacttcgtttttcaccgcgttcatgccggccggacgcccttcgtaaatcgctcctttagagtcgcacatcacgatgtcgcgtacgccgaaatggtaaagaagcttaatgatcgcgatgcctgccgctcccgctccgtttgccacaactttaatggatgacatggattttcctgataatttcagcgcgtttacaagtccggcaacggttacgatggcagtgccgtgctgatcatcgtggaaaaccggaatgtttgtttcttttttcaggcgctcttcgataatgaagcagttcggcgccgcaatatcttcaaggttgacacctccgaatgtcggttcaagcagcttcacagtgtcaatgattttgtccacatcgtttgtgtcaagcgcgatcgggaatgcatccacgcccgcgaaacttttaaacagcaccgctttcccttccatgaccggaagtgaagcttcaggcccgatattaccgagaccgagaacggctgatccgtctgttacgactgctaccatgttccccttcattgtataatcatatactttatttttatcgtcataaatctctttacaaggctcagctactccgggagagtaggcaaggcttaagtcgtccgcgtttctgacttctacctttgcttttgattccagctttccttgatttactttgtgtaaatgtaacgcttcttctcttaatgacattctaaacactccttttaagtactttgttacatattctgccgcatagactggtacaatcgctggaggtgaaaaatttcagaatctttaaataagatagcacaattgtttcaattgtataacaaaacgattattgttaccactattttaacacgacgttttcgcggcccagcagctcttttaaacggtataacgcctgatggtccgcctcaatatgaaaagtatccggcagcctgatcgtctgcttgtctttttcataatatagataaacgccggtttcccctttatgctccagtaaaatacgcttcatcttttccaaaaactcctgattgtgccggctgccttcgattttgatgtaaacagacggcgctctgtctgcctccgtctgttcaagaagagaggcggatgacatgatgaattgtgtcttctcctgacgctcttccatttttccggcggcgaataaaagcgcgccttcttttaacagcggagacagccttctatattggtcaggaaacacgacggcttccatttctcccgtttcatcgcttaatgtgagaaacgccatatgctgacctgtctttgtccgaatcgttttaatgcccgcgagcaaagcgccgattgacagctgtcccttcggcatctgccgcgctgctgtgatcgtttgcgccccccgttttttcaggagatccctgaaagcagacaaaggatggcttgagaaataaacaccgagagcttctttttcgaaccgaagcttgtccacgagcggaaattcctcagcctctacatattttggcttaatggaaaacgattcttccaaaaacaatcccatttggtcatcgtctgcacgaaaaagttcagcgtgctctaaagccacatcaacggaggccagcaaggcggcgcgattttgattgaattcgtccatggcgccagaaaatataagggcttcgatggttttccgattcacgctttttgcaggtacgcgaaagcagaaatcgaaaagatcctcgaacggtttatgtgttcttgctttataaatatctttcactgccgagacgcctacgtttttaacggcccgcaaactgtatctgacggctccgttttccggcgcaaacggaaaaccgcttttgtttattgacggcggaaggacttgaatcccgctccccttcgcttcatgcagatattgcgatattttgtcctcattgccgatgacgctcgtcaacagcccgcacataaaatatagcggataatgcgcctttaaataggcgagctgatagccgatcatgctgtatgcgacagcatggcttctgttgaatccgtagttagcgaattttacaatcagatcgtagacctcgtttgcagtgactacagaatactccttttttaagcacccttcaacaaaatggcttcgctctctgtccagaatgtccttttgctttttgctgacagcccgtctgagcagatccgcttcacctaatgaaaaccctgccatgcgcgaggcgatcatcattatctgttcttgatagacgatgacgccgtaagtgtcactgagaatatttcttacgtcctcgtgcggcacttccacacgcgcccgtccgtgcttccgatcgataaataacggaatattttccatcggtcccggcctgtaaagcgcgttaaccgcgacaatgtcttccagtcttgacggcttcaggcgcttcagcacgtttctcattcctgatgattccagctggaaaatacccgtcgtatcaccgtttgacaatagcgagaacgttttttcatcctgataagaaatctcggaaaaatcaattttcgtattcgtctctttttcaatcatcgttttaatggattcaataagcgtcaggttgcgcaaacctaaaaagtccattttcaaaagaccgagatcttccaggtgatccatcgcatactgcgttaaatacacgccgtcatgcccttcttgaagagggacaacttccgaaagcggctctttactgagaacgaccccggccgcgtgtgttgacgtgtgtctcggaagaccttcgattttccttgcgatctgaaacactttatgaagaacggcggattcggacagccgcctgttcagctgagcggactgccgcctcgcctcctcaagcgtcattcccggtttcgacgggatcaggcgggcaagctggtcggcttctttcgggctgattccgaacactctcccggtatcccttaacgccgcctttgcggccaatgtcccgaaggtgataatctgggcgacgtgcatggccccgtacttattttgtacatactgaatgacctcatcccttctcgtatcagggaaatcgatatcaatatccggcatgctgatccgctcgggattaagaaatctctcaaacagcagagaatgtttaagcggatccacgtcggtaatgaaaagcgagtaagcgacaagcgagcctgccgcggacccccttcccgggcctgtcacaatgcccttttcatgcgcgtacttcataaagtcccatacgatgagaaaataatcactgaatttcatgcgcctgatgacgtccagctcatattcaagccggcggacagcccgctcatcaggagtgccgaaacggagacgcagcccctcatgacagatctccgccaaatagtcatcggctgatttgccgtccggcgccggaaaagacggaagctgtgtctgtccgaggcttacatcgacccggcattgccgggcgatacgggcggccgcttcaatcgcttccggatgccgcgtgtaaagctctgccatttcttcaggcgtcctcaagtataagtccggcagattcccgctctgatcctcccatttctctccggctttaatagcgcacagacagcggtacgcatcttgatcttctttcttgatatagcggacatctcccgcagcgcagacagcgatttccgtctcggctgacaggcggagaatctcttctgataacgtctcatgtcctttaaacggctggtaccctaaataaaaacggccgtctccgaacagctcccggaatccttcggcagcccggaccgcttcttcaaacttcccggcttgaagcaggctttcaatgtacccgttttcaccgggcgtaatggcgatcagcccctcatgatagctcttcatccattttcgcttcatgccgccctttgccatggattgcagcgcacttgagattttcaccaggttctgataaccggtgtttgtctccgctaaaagaatgagcgggtgtgcttcaagctccgtatcgtccgtgtatatagaagccgtcagaccgataatcggcttaattccgtttgatttgcatgctttataaaactcaatggcgccgtacatcacattttcgtccgtcagcgccaatgatgaatatccgagttccttcgcttgtgtaacaagctcttttacagaagcggcgctgtttaacaggctgtagccgctatgtacttgcaggtgaacaaaagacaatgccgccactcctttcccatacgttcattttgtctttctacattataagacgggttttcttaagaaacaaatgttcttttttgactcatcatcatacttgtccgtttcgctcaatatgatagaaaagtgaggtggtgtatatatggatcaggaagccggctttatggcgaatttcatcagcagttattttatcgccctcggtgtgttgctcggcggcgcgctgatcggcggcctcggagcttatttatcaggcgagcctccgctgacggcgatcacaaaattggcgaacaggctgaagatctgggcgcttgtcgcggccatcgggggaacatttgacgcggtatacagtttcgagcgggggctgtttgaaggcaacacgcgcgacatcttcaaacagcttcttttaattatttcagcaatgggcggcgcgcagaccggctggctgattatttcatggctgacccaggagaatatgtcatcatgagaattcccgagtattataaaaaaccgggatggcagcgtttttttgcgggaatgatgtgcggagccatcatcagctggctgttctttctgtttacatacggaacgtttcaggaagaacaggtgacgttaattgaaaagcagcgggagcacgcgcgggatttaaaaaaccaaatctccatctatcagaaagatcttcataaattaaatgaggataataagcaaagacttctcatccaaagtgttgatgtgaagctgattaattgggaaaaatacagaatcgcccagcctgacaagatgaaatttgaggaacaggtgaaagataatatttctgaagtcatcacaaaggatattgaaagcgtgtataaaacaaaggagcttttaaaacggacaattgaaaacaaaatatacaccataaatgagaaggaatttaaagctgaagtaaaggaactgacgatttatacgagattgtctgtcgaaattcatatttcttttgcgacgtaattatgttatttttaaaaattttccatagatctgtcgcttttttctccgcttttttataaactgtagatgagacattttcaacgattctgaagggaggaagggaaaatggaggtttttagtgaacgccgcttggcaaaagatcatgcagcccgaatcagacaaggctattccgcatatgcagaaacagacacactcgcttccctcataaaaaaagaactccaaatctgtaatctccgcgtctacgaagacctgactgaattcggctgctggttcatccccgtgacagatgaacactaagaaagagggtctcccctctacttgtgttcgttacatacctcttccagatcagcaagaatctgatcggtttcatcccagctgaagatggatgcgccggccgcaagcggatgtccgccgccattgtatttccgggcaattccgttgatgaccggaccttttgaacggaaccggactctgatttgatcgtcttcttctacgaaaaacacccaagcgcggatacccgaaatatttccgagtgttccgacaagctgcgacgcttcagaagcggtggttccatatgtctccaaaatgtcttttttaatgaaaacggaagcgacgccgttttcagacagtgacacattttgataaataaagccgttaagcttcaccacatttaattttgtttcatacaattgattgaacagctctgacgatgaaaatgggaactcaatgagctctcccgcgtattttaatgtcttttttgtggtgttcgggaataagaagcgccccgtatcaccgacgataccagcgtagatcagctcagctgctttcgtattcagtttccagccgtgctgctttccttccaggtacagctcatagatcatttcgcttacggagcttgcattcgtatcgacccataacagatcgccatacggatcttcatttggatggtggtctattttcatgagctttgcgccggaatggtagcgctgatcgtcgaccctgccttggtttgcggtgtcgcacacgatgacaagagcatctttataggtttcgtcatccacctcatcgagggaatataaaaaagacaaggacggttcaggctgtccgacggcaaaaatatttttttcgggatacgtttcccgcaggatttctgtaaggccgcactgtgaaccgtaggcatccgggtcaggcctcacatgtctatgtaagataatggtgtcatataatgatatggttctgatcagttcggatttcatcgttttctccttttcgtttttattcatttaatcatactctttatccatggaaaaggaaaatctttcagcaacggtataaacggttttgcaaactcatataatggaggatttcatttatgctggtttttgtttttctcatcgggctttctgcctgcttttacgtgtattacaaagtaaaaggaatccagacgaaacgggcgctggagaaggaatgtttttcggctaaatcaagtatggcattaggcgcgctggtgcttttgtacggagtaaaccaaatgattctgttccactccgtcctgaccctggtcatcggcggcgtcttcattttaatcggagcaggcagcgcatgggccgggtataaagcctataagcattatgagcccatccatgcaaaggaagcggagagggaccacgcataatgaatgccaagggacccgggtgtgtcccttaacttctctccatcagctgcaccatgagcatcgcttttgaaacgatgccgctttggcttgacacttccacttccattttcccgaatttccggcccgcctctaaaatgcgcggtttcacttctatgaccgactccatctgtacgggcttcaggaagaaaatcgtaatgctttcaatgaccagctcgccgcgtttgcgggagcgtaaaaatcggctggcggcctgggttaaaatcgttgtaaacaccccgtaagaaatcgtgccgagctgattggtcatttgcggcgtgacttcatattgataaacggccggcgttttgttatcttcctcttctttaaatccccttgaaacaatatcatccagcttttccccgacctgaggctgcttttgaaccatttgaagcgcttttaagacatcctggcggctgatcattccgatcagtttgtgatgcccgtctgtcaccggaagcacttcaattccttcccaaaccatcatttgagccgctgaggcgacagatgtttttccgatcaccgtgacagggtttttggtcattactttttcaatgggaactgaccggtcatgccccgcgatatctttcggcgtgaggattccgtggattttcatctgctgatcgataaccggaaagcggccgtgtccggtttcatagttcttttcgtaccatttctccagtttatccttagggaacagcgtcactgtccgatctgcgggcgtcaaaatatcttccacgagcacaatctctttttttatgagctgatcatagatcgcccggttgatcatcgcggctaccgtaaaggtatcgtagctcgtggagagaatcggaagctcaagcatatcggccagctcgataatgctgtcgtcggtattaaaccctcctgttaccaaaacggccgcgcccgcttcaagcgcctggcggtgggcgttgattcggttcccgacgattaacaggttccccgccgccgtataacgcatcatcgcgtcaagctccatcgccccgatcacaaacttattcaacgttttatgcagacctgcttttccgccgagcacctggccgtcgatcacattgacgacctcagcgtatgtcagcttttcaatattttcttttttcttctgttcaatccggatggtccccacacgttcaatagtggaaacgaatcctttgttttcggcttccttaatggctctgtaagccgttccttcactgactttcatttctttcgcaattcttctgaccgaaattttttcaccgacaggaagcgaatctatgtatgataggatttgttcatgctttgttgccaagcgtttcacctctaaggacagtcttctgcttttattataagggtacgggggattcattcgcaatgagacgcccgaaaaaaggcggcaccacaaaaaagaccttctgaatgcttgattcagaaggtctttgacacatatgtcaggcaagctcaatggtctcgccgaccgccatgactttgccgacgcctccgggcagactttcagcgaaagcgtcagggtcctgttcaatgacggggaatgtattgtaatgaacgggaacgacctgtttcgctctcagccattcagccgcgagtttcgcatcttcaggccccatggtgaagttatcaccgatcggcagaaacgccaggtcaatgtgattcagttccccgatcagtttcatatctgagaacagcgccgtatcgccggcgtggaaaatcgttttgccgtcaatcgttaataaaatcccggccggcatcccggtgtatgtgatggttttgttttcttcatcagtgaccgccgatccgtggaacgcctgtgtcagttttactttgccgaaatcaaattggtgcgccccgccgatatgcatcgggtggacctttaaacctttaaagccgagataaacggccagctcgttcggcgcaatgacgagcgcatcgttttgtttggcgatctgctctgtatctccgacatggtcattgtgtccgtgagtaagcaggatgacatccgctttcacttcttccggtttcaaatttgtcagactgtttccggtcagaaacggatcaaaaataatgttatgggttttcgtttccacttgaatgacagaatgtccgtgataagtcactttcatcgttttcacctcataaaaaattaatatttatcaagttccctttttgacaaacgaaaaaacttacagggattgatgcctgttaatcacattcagcccgcctgttgcttcaatgaccgttccggttacaagatcggaatcttcttcacataaaaacgcgatgattctcgcaatatcctctccggttccggacctgccgatcggcgtcttttctttgccgattttccgtcttgcttcctctatagacgcttctttcatatctcctacaatatcacccgggcagaccatattggctgtaatgcctgattcggcttcttcaatcgcaatggttttcgttaacgaagccaatccgactttagccgctccgaaagcggaacggtgaagccagccgggggcatggtccgctccttgaaaaccgtatgtaataatccggccgaagcgctgctgtctcatgaccgggataaccgctttaaacagatggaaaacggcgcttaaattcccttcaagcatgccataccattcgtcatcggagtaatcggcaagctttttgcgctcaaatatgtacggcccggcattgttaatcagtatgtcaatccttccaaaccgctgaagggctgcatcggcgatccgcatgagatcttctttccgggttacatcgcccttaacgaattgcaatctgtcatggcacccgggataatccgccttcagacaagcgaccgcttcttcgtcctgtctgtaattcactgtgacagaaaagcctttttccagaagcatttcagtcacttttcggcccaatccctttgtaccggcagtgattagagcatgtcgcacattgaataccctccccaggcaacgtagccgcttcaataaaatcaagacgtttctccctctactttactataaacaaacggcaatatcacttttttgcacttcgtccgcacgaaaaaaaagccgtctttacagacagcttaattttctgaaggagcagaggcttcctccatgccgacataaccgctttggtatgcctctgagataagcctggccgtttcttcactttctttttcatcatagatgtaacggtcttgttctttgcgcattccttttacctcccatcttttatagatgtagggtgtctgatatgacgggaaaatatgaaggaaatttcagcaaattaaatgccggcgcaggcttttgcttttacgagcgcctgttctacctgctgaaaacccgttccgccggcgctcattcttttttcaaccgcatgatgcggatcgagcacggtatagatatcttcttcaaagagactgctggcttgaaggaattcttcaaatgccatgtcacttaaatagattcctttttcaatacagctgtacacaagcttgccgaccacttcatgcgcttctctgaacggcatgccttttttagctaaataatcggcaagttccgtcgcgtttgaaaaatcttgttttgtcgcttgtttcatgatgtctttgtttactttcatcgtttcaatcatgcccgtgaaaatctgaaggcttccttcaacggtttttactgtgtcaaacatgccttctttatcctcctgcaggtctttgttgtaagcgagcgggagtcctttcataattgtgaaaagacccatcatatcaccgtatacgcgtccggttttaccgcggatcagctccgccatgtcggggtttttcttctgcggcatcatgctgcttcccgtcgcgtacgtatcatccagttcaatgaatctgaattcctgcgagcaccatagaatgatttcttctgacaaacgtgaaaggtgcatcatcagcatgctgctgccgcttaaaaactcgagaataaaatctctgtcactgactccgtcaagactgttctcgtaaatggagtcaaaaccgagcagctccgccgaatagttacggtctatcggaaacgtagttccggcaagcgccccgcatccgagcggcgatatgttaatccgcttcatagcatcccgaaaacgctctttatcccgttcaagcatccaaaaataagcaagcagatggtgggcgaaagaaatcggctgggcccgctgcaaatgagtgtaccccggcagaatggtctcgacattggcctccgctttttcgatcagcgctttttggaactgttcaatcagcacgatgatatgcgagacatgatctttcaaatatagatgcatgtcagtcgccacctggtcgttccggcttcttccggtatggagtttgccgcctagcggtccgatttcttcaatcagcattttttcaatgttcaaatgaatatcttcataatcaacagagaattcaagcgctccttcctctgctttttgcaggagagtctgcagcccttgacggatggcaccttcttcttcttccgtcagaatgccgcattttttcagcattgccgcatgagcgagagaccctgtaatatcctctttgactaagttttggtcgaatgtgatggatgcgccgaactcatcgacccacttttccggtgttttttgaaaacggcctccccaaagcttcttcatgcttcaatctgctccttctttttcacaatgctgtttacttttgtcggcagcccccaaagctcaatgaaaccgattgccgcgtgatggtcaaacgcatcgtcttttgtatatgtcgcaagtttttcgtcgtagagagaatattccgacttacgtccttctacaatggcatggcctttaaacagcttgacgcgcacaacgccggtgacatgcttttgggtttctttcaggaatgcaagcagcgcgtcttttaacggcgagaaccataaaccgttatagatgatttcagacagtttttgttcaattgccggtttgaaatgggccacttctttcactaaagtcagatcctcaagctctttgtgagccgtaatcaaagtcatggcgcccgggcactcataaacttcacgggacttaatgccgaccaggcggttttccacatggtcaatccggccgatgccgtgttttccggcagtctcgttcagcttgagaattaaatcagcgagcgggtaggttacgccgtcgattgaaaccggaacaccggcttcaaatgcgatttcgatgatttccggaacgtccggcgtgttttcaagagatgctgtcaggtcatatgccccttcaggcggcgccgcccacggatcttctaatataccgcattcattggcgcgtccccataggttctggtcgatggaatacgggctgtcaagattgatcggaatcggtatgccgcggcttgcggcgtattcaatttcttcttcacgcgaccattgccactcacggaccggagcaatgacctccagatcaggatttaatgatttaatggatacttcgaaacgaacctgatcgtttccttttcccgtgcagccgtgcgctacggccaccgcgttttccttttccgccacttccacgagttttttcgcgattaacggacgggatagtgcagatacgagtggatacttgccttcatacattgtatgggcctgcatagaaatgagcgcgtactcccgggcgaattcttctttcgcatcaatcacataggaatttacggcgccaacttccagcgctttttgctgaacgaatgccaaatcctttccttccccaacatctaagcagcaggcaacaacatcgtatccctgttcttgcagccattttatcgctacagaagtatcaagacctcctgagtatgccaatacaacctttttttgttctgccatgttaaaagctccctttgtataaaaattagttttaattaataaaaatgcattttgtatgtatacactgtaacaagtaaattctgttttttcaagccttttataaaaaaaaccccacccaattttttgagcggagcagagcctttttatacatttataaatcttttcggatttcccggagcacatgaggcagttcaggaataatcagtttactcattgcaagctttacggcgcctgaggagccgggcgtgcagaagactgcggtatttcggatcacacccgctgccgctctggacaaaatggcggcggagccgatgtcctccgtatagctcagcatgcggaacagctcgccgaaccccgggagttcttttgaaaacagcggcgtgaccgcttcaattgtgacatccctttcggcaatgcccgtccctccgtttaacagcaccgcatctgtatattcatccatacagccggataaaacggctttctgcaattcatctttttcatcttttacaatgtcataagcgaccgtttcaaatcccgcttctctgatgaaatccatcatgacgcgcccgcttttgtcggtttctttcgttctcgtgtcgctgactgttatcaccttgcagcgcacggctgacggggcttcttgtttatgttcatgcacactcattgcttcacctcatcgtttatgtattaaacatatcgtaacgtttgattctggggcattcaataaaaaagcacaccctaaaggatgtgcttttttcgatcattactgtgcaagacggacaacgtcacgtgcgatcatgacctcttcgtcagtcggaatgatgatgactttgacaggagagtgagggtagctgataaacgcttcctcgccgcgcacgttgttcagcgcaggatcccaatatacacccatgaattctaagccgcgaagcacgcgttctctgacttcaacgctgttttcaccgatacccgcagtgaaaataatcgcgtcaacgccgctcattctcgcagcgtaagaaccgatgtatttatggattctgctcgcaaacacttcaagagccgtttccgctctttcgtttccttcttttgaagcttctacgatatcgcggaggtcgcttgagaaaccggatatgccaagcagtccgctctttttatttaatgtatttaatacttcatctgccgtctgatccgttttttccataatgtacgggatcaatgcagggtcgatgtttcctgaacgtgttcccatcgcaacacccgcaagcggtgtgaagcccattgacgtatcaatggattttccgccttctacggccgcgatacttgcgccgttaccgaggtggcaggaaatcagacgcaaatcttcaagcgggcggccgagaagctcagctgcgcgctgtgtcacgtatttatgagaagtgccgtggaaaccgtatttgcggatgccgtatttctcgtagtattcgtacggaaggctgtacaggtaagattgctcaggcatcgtttggtggaacgccgtatcaaacactgcaaccgcaggcacatccggaagcacttctttaaaggctttaatgccgacgatgttagccgggttatgaagcggcgcaagttctgaaatctcttcaatctcacggattgtttcatccgtaagcaaaacagaatcgctgaatttttctccgccgtgaaccacacggtggccgattccgtcaatttcgtttaaatcctttataataccgaattcagtcagcttgtgaagcagcatcttcaccgcaaccgcatgatccggaatatctgtcacttctgtatttttttcgccgttaacagagatagtgaaaacgctgtcggcgataccgatccgttctactaaaccttttgttagcaccttttctgaaggcatttcgaataactgaaattttaaagatgagcttcctgcgttaattgcaataattttagacataaatgacgctcctatcaaaattcttcttcgtttgttcgttcttttttcccagaccataactgcggtccaaaaaatatctgacttttccatttaaacattgtcaactcagcatttcaagtcaacatccacattggtaccgcttacaatacgaagtcgatattttctgataaatctcatttgtgccaaatggacggcacggccttacggaatgttattttctttccttaatttgtgttttcgccctgatttccattcattttaaaaagcgaaaagcagcgcggaattttgcgtctcacactgctttttcgccattatttttctttttgaatccactgatccaattttgccatcatctcccgcatcgcctgctggttcgcaaaagaaggaagattcgccaaaagcgcttgtttcggcggctttgcgtcttcgccttttttctgcaggattaaaatgctctttgcctgcgcttcatctttaaacatagtagccggcagctgaagcagggcgttgatatatactttttccgcaaaaaaccgcttcagtttatcgctttgcgcgctgtcaaacagatggttcggaatcataaaaaataagtatccgcccggttttgtatgtttgacgctctgctcaataaataagtggtgggcaaatgagtggccttcatccgctttcagctcaaacgcttcagcgccttcgtcattgggatagtagccgaccggcaaatcgcagataaccgcatcggccggttcgataaataacggctgaagactgtcctggcagaacagctccatttctttttcctgcagattcgcctgcgcatatgcgatcttcagaaggacatcgtcgatttcaatgccgaagctttttcccgctttgtcagaaagctggtttgccgcggtcagcagaagatttccggtgccgcaggcggggtccagcaacgtcaggccttttcggccgcccgtaaatttattcacgaggtaactgatgaaaaggccgatcgtatcaggcgtcatctgtctgttcggatgggacttatctttcagtccttttaaaatggcgagctggaacgccttgcggatccattcatgctcccattttctgaagtctgctttcgcaagcaggcttttaagctcgccggtttgtttttcctgaagcggaagctggtccgttgtttcaagaaaatacatctctcccgcctccgcaagcccctcaatataagaaatctcaaggccttctgctatcacttgggcggcttcatctaaaagttcataaatctgaccgacatgatcgtgttgcatgctgtttcctccttgccatgaaaagagctccgcggcagcacccggagctctttttctctctttacttgattaacgcttttgcagcttcgataggcttttcataattcgggtggtttgtcgcttcgcttacgtattccgcgtaaacgacttttccgtcctgatcaaggacgaatacggaacgcgccaaaagacgaagttctttgatgtaaacaccgaatgcttcaccaaatgacatctctttatgatccgataatgtttccactttatcaattccgttcgctccgcaccagcgcgcttgtgcaaacggaaggtcggcgctgattgtataaacgttcacatcaccgagttttgcggcttcttcgttgaagcggcgtgtctgcgcgtcacatacgcctgtgtcaatggaaggaataacggatatgatcgttactttccctttcatatctgctaatgtcttctcttctaatccgtttgtcaaaaccgtgaagtcaggagcttggtcacccggtttcacttcttgtccgatcagcgtcacggctccgcctttaaatgtaatttcagccattctgattcctccctttatctatgtatagctctatcatagtcgagttttatgcaaactgcaaaggttatgccgcatcgtaaaaaaagctaactgcgggcggcagttaacttttctgttataaatcgatatccgttcttttttggttccggcctttttcattctttttaaacatatgctggatgcgttcaatcgtttgaggcgcggagtctaacagtttatcaatcagatgggtgttttcgtctaaatgaagcatacgcacgccgtttgttccgacaatcagaaacgcaatcggcgtaatggatactccgccgccgcttccgccgccgaacgggagtttctgctcttttctttcatcatcatcggttcttttttcagccggctttcctccaaactcgcttccgcccgccgcaaatccgaatccgacctttgaaaccgttaagattacgctgccgtcaggcgtttcaacaggatcgccgatgattgtattcacgtcaatcatttcttttaaattttccatagcggttttcattaaaccttgaatggggtggtctgccatatgcgctcctccttaaactgatgaatcattctttgaagcaaccggaaccggctgtttctttcgtatgatagaaagtccgttccgcccgtatttgagcaatttgaaagctgcacctataagatgtccaaaacgaaaaaagaatatacactgcaaatgcgtcttggatgcaggcacttgaaaagacggaatgacttcgcacaccggtttatgtatgaaacgcagatgatcatacagcatcgccgtaaggcctccctttacggcccacaatccgccggcggcgattcccgtaacggcggcgtcctttattccgataaccgtcacccattcaaacttcgtaacacggactcccgcaagaaatgaggcggcgatttggcgcatctgcaagacttggtgcagaatcatttctattctgtgaatgctctgtttgacatcttcatatgtgatttttttcttctcttttttctgacctttcatttctgatttcgtgtcctgtttgacatcaatagacgcgtcttcgctgtttactttaatgacgggcagcgtttttttaaaacggaccagcccgtataaggccgagagtttaaacgtcagtttgtcgttatctttatcgtgaagatattcgaaagtcagatggattttcatcctcatgagcagccagaccaaaatgagaatgagaataacagctgctgcggcatatcccataggcttcacttccttagcagcattatcgccaaaaccaaaaaaaataaacccggacgtttattccgggtttactgcttttatttgcggtacagcgcttcgtgaatcaccgttgtgtcggcgatcagatcgtgaatgccctgctttttgggcgtaaacgcaatgacgatatagagaatccagattttatcgatataacgccccaccgcttctctgaaaatgacggtgctccaagtcagcggctttccgggcgtcaaagaagtgacctttaacccgaagaccatcttgccgagtgtctgatgaaaccatttcgtcatgaacacaaaataggcgaggtagacgatcagggttgtgacggaataagctgagattgtaaacattccgcttgttgccgggagcttcatcagcgtgaaaatcggtgaaacgatgagatggttaagtccccagaccaccagccaatcaagaagaaacgcccaaaacctgatccaaaagcccgcatatgcctgctcgggcgccctctgttgttcggcttcctcttctttgccgtgaaagccttcgtaagtcgcgtccattctttcttcccccctactttgcatagagatacatcatccgcggcgaaccggattgcgaaatgagttctttcatattcagaaaatcaatttcgcttttaaacattttcgctgcgctcatggaaaagagcgagcctaatccgaatccttcctcgtatgtgatgactgaagcgtttttcatatttttatggtcctttttcatcgcgctgatcgtatcatcgtaaaaaccgagctcatcaacgaggccgatttttttcgcttgtctgccgtcgtaaacacggccgtcggcaatttttttcacatccgcttttgacatgtgccggccttttgaaatgacattgacaaatccttcataagaatcgttgaccattgtctgcatgatctttctttcttccttcgtcatgtcgcgggtcggggacatgatgtctttatgcgcgccgcttttaatggtttcaaacttgatgccgagttcatcggcgagcttggaataattgacgctttccatgatgacgcccagtgaacccgtgagcgtttccggtgaagcatagattttatcggcggccgttgaaatatagtagcctcccgatgccgccatggagcccatggacacataaatcggtttcttcgtttctttctttagttcttccagttttttatgtatttccgcgctttcgtacacgcctccgcccggggaattgattttcagtacaattcctttgacgcttttatcttctttcgcacgctcaacctgttttaaaaatgatctgtgatcatacccgcctgagctgagcaggccagcggacccgccgttatcctcaatcgtgccgtccacttcaagcacggcgattttactgccggggctgcccttatccagcgtcacttcctctgtgtcatctgtcagtgatgcaaagtcagaccctgtatctccgatattcttcagcaccccgacggtcacacttgcaatgaccgatacgccgaaaatgccgagcgcgatgacgagcgcaatccatctttttgcattcatttgttctcctccttttctgtcaatattcgtacgttcccccgtaaaaaaagattcatttttttcatgaagcgctttctcttaacggataaacaggaaacatgttacactattgccacaggtattttaacacaatacctgctgggagaaaaacgtaaatatgacagcaaaggggaatggggatatgaccgatcttcgccgcaatgtttatttttttcacaaacaaaacaacgaaacaaaagaacaagtcagctctttgaagcagcttgctgaatcgcacggttttacagttgcggctcacccggaggatgccggaattatcgccagcatcggcagcgacggctcatttctgcaagccgtcagaaaaaccggattccgtgatgactgcctgtatgtcggcatcgctaaaaaagggaaagcccatttgtactgtgattttcacagcgatgagcctgaaaaaatggcggccagcatgaccgcggaacagcttgaggtcagaaaatacccgctcattcatgtaacggtggacggcagcaatcattttcactgtttaaacgaggtttccatccgttcaagcattattaaaacgtttgtgatggatgtgttaattgatgatcttcattttgagacgttcagaggagacgggatgatcatttccaccccgacgggcagcaccgcctacaataaatctgtttcaggcgccgttgttgatcctttgatttcctgcatgcaggtatccgaactggcgtcgttgaacaacaacacataccgtacactcggatctccgtttattttaagctcagaccggaagctgacactgcaggtggtccaggacggcaatgagcatccgattatcgggcttgataatgaagcgctcagcacgcggaatgtcaaaaaggttgagattacactatccgataaaaaaatcaaaacggtgaaactgaaagacaactctttctgggaaaaagtaaagcgatcatttttatcataaaaaaagaggacgggcatcactgcctgtcctctttttcatatacgatacggccgccgacgacggttttgacagcttccaattcatgaagctttttcggatccgtcccgaacggatcaccgctgagtacggtaaagtcggcatcatagccgggggcgatccgtccgcggctatgttctttatggatgatggccgcgcttccctccgtgtaaagctgaatggcttcgtacacggtcaggcactctttttcataataggccggaccttccggatgctgcttgcttgtacggagcacagccgattgaatgcccagaagcggatcggccggctcaatcggggcgtctgagcctccggcgcacagcagcccttttgacagcagtgttttccaggcgaaagccgttttcatccgctcttctccgagccggtcaatcacccacggaaaatcactggccacaaaatgcggctgaagatcaagtccgatcggcagccgggcggctctttcaatcaatccggcatctaatacttgcgcatgaatgagcctgtctagctgtccgggctttgccgggtatctttcgataacatcgagcaccttttcaaatgcaaggtcgccaatcgcgtgcacggcgatctccatccctttctctctcgctttataaacaagagcggcaagggtctcgtcatcgtgcacctgaacgccggaaactgacggatcatcatgataaggctttttcaacagagcggttctgcctccgagcgcgccgtcagcaaaaattttcatcgctccgtattccaggtaaggtccggtcgatttatccagagcgctccagctgtcgacggcttcgtgatgaacgagcagatgggcgcgaaaaggataaaggccgctgccggttaaagactcgtacgcggcaacgggaacggacgcgtctccgtagtatgccagatcttctgaatgcccgcctgtcaggccttttgaccagcagtccgtaatcgccgtttgaagcgcgcgtttgacatagtgaagtgagacgggcggcagggcctgtgtcacaagctcttgggctttatccagcagaaggcctgtcggaccggtgccgtcccggacgataatcccgccgtttggatcagatgtttcgtttgtaatccccgccgcgcgcaatgcggccgaattaaccgcaacggcgtgccggcatacccgcttcagcaggacggggcggtcgggaaagagcgggtcaaggtcatgcttcgtgacgtaatccggccgttcaaacaggttttcatcccagccttcgccgatcagccattcgccatcttccaattcacgctctgcttcttttgcggcccgcaggatcgcttcttttgacgtcagctgcgacaaatcgaggcgaagctgtttttccccgtgtccgattaaatgcatatgactgtccgtaaaccccgggaacatgacagctccatgtaaatcgatttcctccgtatcaggcgaaccgtatgttccttggagctcccgatagctgcccgtcttcctgacgacgccttcttcggtataaacggattcagtgacatgattcttgtcaagcattgtatagatggtgccgccgtgccaaatcgctttcatccccgctcaccctttatcctgtattatgcttttttatcagccttcagccgttcttcacgctgtctcagttccacacgtctgatttttgcggacgccgttttcggcaggctttcgacaaattcaatctctctcggatatttgtaaggcgccgtaatcgtttttacgtggttttgcagttctttgacaagttcgtcactccgcttttcatcgtcttgtaaaacgacataagcttttacgattgaacctctgatttcatccgggcttgccacgactgcacattctttcacttccggatgcttcacgagcgcgtcctctacttcaaaaggtccgattgtatatccggagctgacgataatgtcatcattgcggctctcaaaccaaaagtagccgtcctcgtcttttttcgcgcggtctcctgtaagaaaataatctccgcgaatctgctttttcgttctttcgggatctttataatattccttgaataaggccggtgtgctcaaatgcacggcgatatcgcccgtttcgcctgtttcgcatatttcgcccttatcgtttataatctctacttgatttccgggggtcggtttgcccatgcttcccggcttaatatccatatccttcaggacgccgactaacagggtgctctccgtttggccgtatccgtctctcactttaataccgaaatgcttccggaatacgtcaatgacttcccggtttaatggctcacccgcagaaactgcgctgtgaagggcagaaagatcatatttgtccaactcctccacttttgccatcaggcggtattccgtcggggtacagcagaagacatttacttgatggcgctccagcagctctaaatacgtcttggcgttgaatctgccgtgataaatgaatcctgtcgcgccgcttcccagaacggcgagcagcgggctccacacccatttctgccaaccgggcgccgcggtggcccacactgtatcgtcttcggaaatatccagccatgcaccggctgatgtttttaaatgggcaaaggcccagccgtgtgtatgtacaacgcctttaggctggccggtcgtgcctgaagtataggacaaaaacgccatgtcctctcttgttgtatcagctgtttgaaaactgtttccgtccgcttcaatcgttaagaggtttttccagccggcatcattttcaccgattgacaatgtcaccagctgctcggtattcacctcgtcaaatgcgtttataaatgaaggataaacgatagcgcctttcacttcggcgtgtttgatccggtattcaaggtctttggcgcgcagcatttccgagcaaggaatgacgaccatccccgcttttaagatcgctaaataaacggcatacgcttcaagcactctcggaaccatgacaatcagcttatcgcctttttcaaatccgagacctttcaggcgggctccgattttattcgtttcttccatcaatttttcatacgtccagactttcttgccgcctgtttgatcttcccaaataagcgcgttcttctctttggaacggctgaacttttcgatttcatttacaagattatagttctttggggcgattaaatcttctcgttttaacacgaacaactcctcactttctttccccattatacataaacataggccattacaataaaaatatgcataaattgcttccagccttctatctatactcatgaaaaaagagcggggaattccccgctctcttagccattatgtgaagttgtgattaaaactgctgctggctgcttccgcccatgctttgctgagcaaaagagacaagacgttttgtgatttctccaccgacagaaccgttggcgcgagaagttgtttccggtccaaggtttacaccgaattcagaagcgatttcatacttcatttggtcgatagcttgagcagcgcctggcactaaaagctggttgctgtttccgctgtttgattgttgtgacatgtgtatcacctccttgtgagtatagaatgtgataaaacacatgtcttcattcaaaaaaactttggtaattgtatacagttttaaaacaggccggcaaacttatcgtgagcttcctgctctgagtaaacagtgatggtttcgatgccggcagcggcctctgcaatcagcggttcaaaatcaacgaagctttcgaagtgctcgattttttcttttttcggacgcgttttcggacttggcggcgtaaagatggtgcagcaatcctcaaacggctgaatgcttgtttcataagtgccgatttcttttgatttctcgatgatttctgttttgtccattccgattaaagggcgcaaaaccggtgttgccgtcacggcattgatcgcatacatgctttcaagcgtctggctcgctacctgcccgaggctttcccccgtaatgatcgcgagcgcttttcgttcttctctgattctgtccgcgatttgcagcataagacgccgcgtcgccgtcatcgtatagttttccgggatttgtttttggatgagttcctgcgtctttgtaaacggcacgatatgaagcgtcatactgccgccgaacttcgcgaggcatcccgcgagatccatgactttctgctttgcccgttcgctcgtatacggcggactgaagaaatgtacggcttcaactgataatccccgtttcatcgcgtaaaaaccggcgaccggactgtcaaaaccgccggaaagcatcagcatcgctttacccgcggaaccgacaggaaggcctccggcgcctttttcgttacgaatggtcaggaatgtcgcttcctccctgatttcaatccgaagcggaatatcgggatttttcacatcgacggttaatccatccgtgtttttcaaaatatggccgccgatttcagcgttcatcgcattcgtatctaattcaaactgcttgtaagcccgtttggtctcgaccttaaacgtattccccggtttatattcgccttctatcgcggctaaagccgtttttttaatgtcttccagcttgctttcgcatttaattgcgagactgaaactttgaatgccgaatatattctttaataaggaacaaattccctccgggttttctccattaagtgtaattgacatccggtcccggtttgaaaagtattttacttttttataatcctttaataccaggcggatattttgttttaatctttcaataaaactgcgtctgttttttccttttgtggatatttcaccaaaacggattaaaatatgatcgtaattcatatgctacctcatcattttttttagtttttgaacagccggcaccagcgcggccataaacggctccgtgatgtcagccgtatgcatgaagttcaggctgactctgatgctgcttgatgcaacctgttcgcctttattcatttgcagaagaacacggctcggtttatgctctcttgccgaacatgccgcggttgtggagacatatattcctttttcctcaagcatgtgcagcagcacttcggccttcacgcccggaacggaaaaattaatgatatgcggagcgctgttttcggcgggagtgttgatgacgaccccgtccgccccgctcagcctttccatgagcgcattcttggcagcctccacggaagaaagccgctcattcatgtcacgcgcggaaagattgatcgctttcgcaagggaaacggcgcctgccgtatgttctgttccggcccggacgcctttttgctgcgagccgcccgttataagcggaatgagccgcgttccttttttgacgataagcgctccggtcccttttaagccgtgaaacttatgccctgaaacagtgcaaaggtcaatgcccgcttcttctatagacagaggaactttatgaatgccctgcacatgatcaacatgaaacagaatattccggtgctgcttcaaaaacccgccgatttcctttacgggctgaatggagccgacttcgttattgacatgcatgacgctgacgattatcgtatccggcctgatagccgatttgacgtctttcaaagaaacgaagccgttttgatcggccggaagatatgtgacttcaaagccgaacagctctgtcagctgatcaagcgtctccgtcacagaaggatgctcaatcgccgaagcaatgatatgtcttcctttactcatgtttgcccaggccgctccctttaacgcagcgttattcgcttcagtcgcgcctgatgtaaatacaatatcataattttttaaacgtaaggttctttttatttgctgagcggccgcttcaaggagctgctccgtctcagttcctaactggtgcagagacgaaggattgccgaaataacggctgctcgtctgtttatacacttccaaaacctcttcatacggctcggtcgttgagctgttgtctaaatatatcattttttttactccttttatgaaaacggtacatcgtatgatatttatgctaccataacaaaagtaaatagaaattcgcaataaatcgagtattgacttctctgtacattgccatataataagtaatgttcgttttgttatattatctgacaattaattgacagaatatttcaacatagtatttaggaggacttttatgaaacactcactacctgtcaaagataccgttattatcggtttcatgctcttcgcactttttttcggggcaggaaatatgatatatccgccggagcttgggcaagcggcggggcataatgtctggaaagcgatgggcggtttcttactgaccggcgtaggactgccgcttttaggtattatcgccatcgcattaacgggcaaagacgcgaaaggacttgccgataaggctcacccggtattcggcactattttcaccgttgtgctttatttatcaatcgggccgcttttcgcgattccgagaaccggaaccgtttcatatgaaatcggtgcagttccgtttttaagcggcattccggaaagattatctttatttgttttcacgttgatctttttttctattacgtattatttagctcttaacccgtccaaaatcgtggacagagtcggaaagattttgactcccattaaattcggtattattttaatcattgtcgtaaaagccatcgtcactccgatgggcgggctgggcgccgtacatcaggcatattccggaacgccggtgttcaaaggatttttggaaggctataaaacaatggatgcgctcgcctcaatcgtcttcggcgtcgttgtcgtcaacgctgttaaaagcaggggcgtcacccagcgtaaagcgctcgccgccgcttgtattaaagcgggtctgattgcagcggcgggtttgacattcatttatttatctttggcctatttgggagcgacaagcacggacgctgtcgggccgctcggcgaaggcgcaaagattttatcagcttcatctgattacctgttcggttcactgggaaacattgttctcggtgccgccatcaccgttgcgtgtttaacgacaagcatcgggcttgtcacatcttgcggcgaatatttttcaaaattgattcccgctttatcatacaaaatggtggttacgattgtcacgctgttcagtctggcgatttcaaatttcggacttgctgagattattgcattttcagttcctattttatcagccatttacccgctggcgattgtcattatcgtactttcctttattgataaaatctttaaggaaagacgcgaagtctatatcgcctgcctgatcggaacggggctgttcagtatcctggacggtttgaaggcagccggcattccgctcggatcattagattcattcttaaacgcaaatcttccgctttacagcatgggaatcggctgggtgcttccgggcattgccggagcgatcatcggctgcatcatcacgttttttatcagcccgcccatcgaattaaataaagcaaaatcgtaacattcagcgcctgcggtttgatgtatatcagccataggcgctttttatattccgtgagaaacaaaaaaactgcacctctgatttccatcagggtgcagtttttgcttgtgcgtctatgaagcagattgatcagctttaatttttttcacggcgccgggagctgctttttcaacagcatctgccgccatctcataagcttcattatagctgtaagcgtaaaacagccgttccgcttctttcagctgttcggataaaatatgattctggcttcggaaacggttgccgtactgaatgatccgctcaatcagcttcacctgaatcacaagttcttccgcctcttcgctgacttccgcaaccaccttttcagcttcggtcagatgtttggcggcttcctccatgtttaacggcagctcttccaattggctgacggtctcttctatatgatgatttgccgtctcgagcttgtccttgacttgttcaggaattcccggcacgttgcttttttgcagcattcgggccgtgtcagaaatggttttccgaagattcatcagcgtttcccgcgcctgcagttcttcttttctgagcgcctgcagattttcacggtattcggcatgttctttctgagcttcttccatctgcttttcgatggcctcgacttcttcaatcagcagcgagtaagcgacatgctcaccgtcaagcttttctctcgcctgctcaaggagccggccgatcgtttccagctgtttttcgaaagcatgctgtctgccgatttctcccgccgtcagctgatagctttccttgacgagctccgtttcggtttttgtgcggtctttttcttcctcaagcttctcatacgcgatgatcagctcaggcattttgcttaatacggactgtccggcttccacttcgccttccagctgttcatacatcgattgaatggtttcatcaatcagctgaagaatggcggacgcttcgtcgacatctaattcttccaaaagcgcgctttcggcccgtttcaattgattggtgagtgtctccagctctttttcgatttgaatatgctccaatttgtagcctttttccgtcatttcccggtagccgtctttcagcttggcaatttggttaggcacggtctgtttacagtcagcgagcagtttcggaacgtcatctatgtatgtttgaagctgatccagtctgcggtcctgttcaagcagcacttttctcgctttgatgtaattgccgctttccgtctcttcttcgaacttttttatgccgctccagatttcgtcgagatccgtctccaggctgttatatagctctccgtagagatggctatacgccagaaggttttttcgcgcttttgaataccgctcacgcacctgttcaatctctccgcggcttttttcctcgctcgtcacaagatcgctgatctcacgcagtatgccttctatatttgattcggctgcagtgaggaggtcgtcgatgtggacaagcacctgattcgcttttttaaaccggtatttgtcggcgttctcttcggcatcataaaggagctcttctactttcggcagatgggctgtgacaatttcatcccactcttcgcgccatctttcaaagaactcttccgtctctccggtcattttcagatgtttgatcttggacatttcttccactatcgaacggtttaaaatttcaatcttccatgactccagccggtcaatttccgtataaatttttttcctgaaaaagtagcccgccgcaaagagcgcgagcagtataaccaataatccgatgactaactccataatgagcccccttgttgttctcttaatctgtcagggtgttttatgtattcagaaagatttcaatatatgtattgagaaaatctgtcgttttcattgttattatgataccatgtaaccaacattttttgaccagaaatcaaaaactttttgcataatttcggcaggattctgcaattttttaatggagtgacacaaatggaaaaacgagacgctcatatccacacgcctttttgccctcacggctcgaaggatgcgctgaaagaatatgtcgaaaaggccctggaaagaggctttgactcgatcacatttacagagcacgccccccttcctccgtcatttcaagatcccgtaccgcttcaggacagcgcgatggatctcagacagatggaggtttatttggagcggctgtcacagctgaaaaaggaatacgatggacaaatcagcattctgaccgggctcgaaactgattttatcacagggtatgaagaggaaaccgcggcgtttctgaacacgtacggcccctcactggatgacggcattttatccgttcattttttgaagaccggtccgtcttatatctgcctcgattttgacgagcacgcctttcagcagctcgccgcgcacttcggaagcgttgaagccgtatatgaacaatactatgaaactgtgtattcttccattgtaacaccgctcggcccctttaagccaaaacgggtcggccatatcacgctcgtcaaaaaattcgcacgccttttcccttacagcatgtcacctcaaataagagagcttgcggcccgctgtcttgacgccgtgaaagaacacggaatggagctggatgtgaatacatccgggctcagaaagaagtttgccggggaagtatacatggaggattggatggctgagaccgcgaagcaaaaaaaaatcccgctcatattcgggtcggacgcccatcaagcggaagatgtcggcagttcctatgaaacgtacaaaagcatcattacttcataagcgccgcatcaggccgtcggaacacgctttcgatccagatcttcacctcttcaaaataccttttataaaagtacggttcatgaggctgcatatagagcacctctgtaatgtattgaggctgaagatacggcatcatcaagagggatttcaattgcagaataaaatgcggcacgggcagcgtcagccgtctgtggcgtgactgcccttcttcaatcaccagctggaaaatatatttttctttcattaagtaagtagacataatttccctgataagcacggaatcaatcgtcacttcccggtacacaaaccgcgttagttgacggttatcgtgctgataggataaaatatcgaaaatcacccgcaggatgcgttcctgcgcgtcttcaccgttcaaactgacggcggctttttccagcgcttcagtatagccttcgtaaaactcggaaactaaatgttccattaatccgcctttccctttaaaatagtaggagatgtgcgcaacattaacatcagctgactttgcgatttcacggacggacgtgccggaataacctttttggttaaacagctggacagcggcgttaataattttgtctttggtgcttactttcatacggctcacccctttatgtgtaacaattcaagcagaaaggcgccgttcctgtaagaacttctcgacaaatgccggcagaacggccggaactttgtttgatattatagaaaaagtgagggttttccatgtttcatgtcgaaaaacaatccggagataaagaaaaaagttatcagcttctgcttaaacagctcgaagccatgacagaagatgaaacggatgcgatcgcaaattacgcgaatgcatcagcgcttttataccattcattacatgaagtcaactgggcggggttttacttcgctaaagagggcgagctcgtgctcggaccgtttcaaggacttcctgcctgtgtgcgcatcccgttcggcagaggcgtatgcggcactgcctactctaacggcgccgtgcagcggattgccgatgtgaatgcgttcccgggacatatcgcctgtgacgcggcttcccagtcagaaatcgtcctcccgatccgcgtaaacggtgaagtgatcggtgtgctggacattgacagccctgtgaaaaaccgttttgatgaaacggacgaagcctatttagcaaagtttgttgaaacgcttgaaaaacgattaggataaaaaaaggagcccggccggcaggccggctccttttttatgtcgtcgtgctgttttggtggatgatcagccggtttttgccgttccgtttggcgatataaagcgcctcgtccgcttgctgaacgagcattttcaacggcatcgggcctgtctttgaccagcaggaaacgccgcaggaaatcgtcacgcgcggctcggtgttttcccggatggcgcgaaccagccttttagcgatgcgttctccggatgacacgttgatattcggcagatagacagccagctcctcgcccccccaccttgcagcgacatcatgctcacgaatatggtttttcataacggaggccacctgaatcaggatcgaatctcccgtttgatgaccgtatgtatcattaatggttttgaaattatcgatatcaacgaggatgaatacaccccgtttatgaattttcatgctgtattgaattttctcatccaaataggttcttgaatacagctccgtcagctggtctgtctgaacaagatgctcaagcctgtcgcgcagcatggagttcgtgaccgccaatgtcgcatggtgaatgagcgcttgaaaaagcttatacatttcaaacgtaaaagcatacaaatcctttttcaataaaatcgcgaacccgaagacggtgtcattttcgatcatcggcaccgccatcagcgagccgaagccgttttcgccgaatacagtctttccgctgccgataaacacgcccttttctccctcgaacagcttttctttcacaatgctgatataggggttcgcacgttctgtcttaaaaaaagcggtatgtcccggaagcagattttgcgtctcaaaatgatcaatatgaaaaaaagccacttcttccgcatgaaatgattgggtcataatggcggcgagttcccgcatcgtgtcagtgagtctgaggcgctgattcagctggcgcgatgtttcattaatgagctccagattcgcaatgctttttttcgattgctcatagagctgcgcattttcaaatgcttttcccgccgcgcccgcaagcagcagcatttcactgagagtactgcacgaaagaacggcatcctgcagcccctccgtcttcagaaccccgtaagtcccctgctggcctttgatcggcaggtaagcagatgacctgccttttctgagcagtctccccgataaataaaccttcagggcagacggatcggcatcttttccatccatatgtaattcttttgcgggaagctgtctgtccgtatcctgatcctgcgtgataaacagtgaaaagcggaaagaccggaaagccgtactcaaacttgcctgcagtttttccaaaacctcattttgatccaaaagcgaatggaacatttctgtcattctgtgaattttccgctgatgcttcgttttgtcaaacagcccgctttgtctcacagattgattgataaactgagtaacgatctcaggcaatgattccgggatcggcagcccgccttccgagcgcagataaaaggatctgccggacgtctgattcctgatcataaaacggccgtcactctctttcagcggagcataatgcggttcatcttctgtttttatggtgaaacgtgttgattctgccggtgaaagggtcaatgaaagagatgtaaagcaggattctagagctgaggccagccataacagcgagtcggataatgagacggattcagatttcgttaagaaaaaagaaagcattttctgatgaaaggccgtcacttcatcaattgtttgttttttcatttttatcacctaaacatgtactactcatttttgtacattatatcataaaccggcactcttcatggagaaatggttgacggcggcggggaaaaatcatataatgttctttgtgtgaaatattgcagcctttttgttcagcttctgtgtttgcattttgttccttagctgtaaggtgtatcgtgtaactctctgctgctggagcgaggatacatgaaaacaaaatgtgcacggtcggatcgaacagacggtttttattttccacaaaataaaaccaaaggaggagtcacattatggctcgctatacaggtccatcttggaaactgtcccgccgtttaggaatctctcttagcggtacaggtaaagaattagaaaaacgcccttacgcaccaggtccccacggtccgggacagcgtaaaaaactatcagaatacggtttgcaattgcaagaaaagcaaaaacttcgtcacatgtacggtgtaaacgaacgtcaattccgcacattgtttgacaaagcggcaaaaatgactggtaaacacggcgaaaacttcatgattcttttagatgcacgtcttgataacgttgtgtacaagctcggtcttgcacgcactcgccgtcaagctcgccaattagttaaccacggtcacatccttgttgacggaagccgcgttgacattccgtcttaccaagtaaaacctggtcaaacaatcggtgttcgcgaaaaatcaagaaacctttctatcatcaaagaatctgtagaagtaaacaacttcgttcctgagtaccttactttcgacgctgaaaagcttgaaggtacattcactcgtcttccagagcgctctgagcttgctccggaaattaacgaagcgcttatcgttgagttctactcccgttaagtaaaacgctctttaaagagcattggattaaaccccggacatgttgtgatgacaatgtttccggggtttttcttttgggctgttccctctctttattaaaaaagcccctgtccggggcttttttttatgtgccaaccggcttttcaactacatgtacattagaaaaccccataatgcctgcaacagataatgccgcaaaaagaattctctttttcatcaaattcctgccgaaacgcagaaatgagtttgttattttttctgactcaccttaatcatttgacaggcagaagcgattttttacataatgaatcatcatacttacaaaaaggagagacggaatgaacagcatcccctctatcgtcagcaagcacaaagcctattttgcggcggggcatacgagaccgctagaatcaaggctgaacatattgcaaaagctgaaacaagccatcaaaacacaagaagccgatatagcagccgctctctatcaggatctccacaaatccgaacaggaggcgtacacgacagaaatcggaattgttctggaagaaatcagttttgtgatgaagcggctgagaaaatgggtcaaaccgaagcgagtcaaaacgcctctgactcacctgggctcgaaaagcatgattatccctgagccatatggaatcgttttggtgattgcgccttggaattatcccttgcagctggcgctttcacccttgattggagccattgcggccggaaacacagtcgttctcaaaccgtcagaatatacgcctgcggtttccgctgttctttctaaacttatcagcagcgtttttccgagtgattatgtcgctatggcggagggcgggcccgacgtcagcactgttttattacagcagccctttgactatattttcttcacaggaagcgttgccgtgggaaaaatcgttatggaggccgcctccaaacaattaattcccgttaccttggagctcggcggcaaaagtccctgcattgtccataaggatgctgatatacagcttgccgccaaacgcatcgtcttcgggaaatttacaaatgcagggcaaacctgcatcgcaccggattatttagttgtccaccaagatatcaaaacgaagctcatagaagaaatgaagcatgcgatcagtgaattttacggccctcagcctgaacaaaatccgcagtacggcaaaatcgtcagtgaacgccactatcagcggctgctcagctttctgaatgatggcgtcccgcttacaggcggacaatttaatcctgaacaccacaaaatagcgccgacgattctagatcaagtgaaggatgactctccagtaatgcaggaggagattttcgggccgattcttccgctgtttacatacggcgatatcgatgaagtcatcgagaaagtccaatcacgcccaaagccgctcgctctttatgtcttcacaacaaacaaaggaatcgagcgaactgttttagagaatctgtcatttggcggcggctgtgtcaatgatacgttaatgcacgtcgcgacaccgtatttgccattcggcggcgtcggagaaagcggcatcggcagctatcacggatttaacagctttaacgcatttacgcacaaaaaaagcgtcgtcaaacaaacgaaccgcttcgacctcgctttccgttatccttcttccaaaaacgggctgcgaatgatccggaaaatacttaaataaaaaagcgcagagtatctgcgctttttataaatcatctatacaccaattaatcggttcgtctcccaaattaaacctatttttaaaagttcaaatcgaagtctaaccgcaaaaatgaaccaacccaactgtaggaaaggttaatccttatcaccctggtgagtcctataataattttcagcggtatagatattccactcccaaaaatttgctccttgacacaaaatataccgatctaaaaatatctcaaaattaagtttcattggttcatactcaataaatccgcggaaccataaatagtttggatctgtagaaattttggttttgtcaattaacaaataacatccgtctaacagatgtgcgacaggaataaactgaggctctaaaaaaccattttgcatatacttttcaatctcttctaaatcaagaatatgcaaaccccacctacattctcaccgtaaatcaacaaatcaaatattctggctccgttatgcaattttaaaaaggttttataatcttcaggaagtgagacttttattttcttctcaaaactctcaatctccagatctgttgcacctttaaagaaagtacattctgtttctaaaagcgttccttcattccctaaaatgttcaagcggcctttttcatcaattaattcttttagaccttggagcgttttttcaacaaaaactgccattgagccacctcttattattagagcattgctattttattcacaagagcaggagccaatgttccagttgaagtatcaggaagagaacctttccatccggctactgaagtatgttgggacataaaaaactttgtctttttaggataatacgactttgaatatgatttacctgcttgaaaattctatgttatggggaaaacctttcgtattaaacatataaagacagtctgttaaacagactgtctaagatgttgttacatcacaccatactcagctgcggtttaaataattcatagtgaatggattccggcgttatattgaattcagaaatcagctttttcatttctttaatgaacgacggggatccgcacaggtaaaaatcagcatctttatctgtcatcacttcttctaacagctgtttgtcaatccggccttcccgaaaacgaatgttttctgaacggtcttgttcggacggttcgctgtaaataaagacggtgtcagcggatgagtgttccgcggcttcttcagcttcatgccgcagcgcatgatactctccgctccttgccgcatggataaagagaacgtttcgctgcggctgggttttggcaaccgtctttaacatgctgatcatcggggtaattccgacaccggcactgatgagaaccagattctttttggaatcagggtctaatacgaaatccccggccggagcgctgatctcaattgaatccttttcgtgtaattggtcatgcagatatgaagaaacaattccgtcttttttcacggaaatccggtaataatccttaccggatacatccgacaaactgtactggcggatatgcgtataacccgtgtccggaatgtatacttttacactgatatactgtcccgctttgaattcggggagaacttgtccgtcttccggttttaaataaaacgacgttatctctttgctttcttttacctttttatcaattttaaacgccttatcgtctttccagccgcctttttgcgtttccgcttgtttatacatgtccttctcaattccgataaaagcgtctgcaatgacgccgtatgctttttcccatgcctgaatgacctcaggagcagccccgtcttttagcacatcctttatcgcgattaacaagtactttccaacgattggataatgctcgggcttaacaccgatactccggtgcttatggctgatttgtttgacgacggggactatgttttccagccggtcaatattggctgcggccgcaatcacagcattcgacaaggccgtacgctgtgtttttttcttttgattcgtctgattaaagatattcagcagctcagggtgatgctgaaaaagcaggtcataaaatcggcctgtgatttcttcaccatgctcttctaagaccggcactgtgcttttaatgatttcaatcgttttttcatcgagcattctgaaatccccctaaagatgtatgcatctcgattgacctgaaaaaagaatcgtttttgaattcttttttatagatttccccgttcaaaaagggttagccattccaatttgagacggattcaggaaaaaccagataaacgaaattgcggatggaaaattgtggacttgccatagtgtacttgtccgatgcaaaatcctccttttcagcatttaataaagtacgggaggtgagatgaatgggtaaaaaatcgaaagtgtattactgtgaccctaagtatattgtgactgacaagtatactgacaaagaagtggtttacgtccatcccatcaaacacattaacagagaacatatccgttatgttccccgccacgtttatcaggaagaaacaattcacgaagtcattgatccgggcgatccggggaaatgcgggtgtaaaaaggataaaaaaagacgcaaaaagtaattggttcgatttcttgcctcagcagacctccgtaccttttggctcctctttttcagaggggtcttttttcatgccgtatcttcaagcaaatacgttgtgaggcggcaatccgcctgatattcttgtcatatacaaattcacaggaggcatgatgatgagcaaaaaaatcgcagttctgatgacagatcaatttgaggatattgaatatacaagcccggcggaagcatttaaagaagcgggccacagtgtggtgacaatagatttagaagcagggaaagaagtgacgggcaagcacggtgagaaagtaaagatcgatcaagcgatctcagacgcagaccccaaggaattcgatgcgttattgattcccggaggcttttcaccagatcttctgcggggagatgaccgcccgggtgaattcactaaatcattcgtggaaaatcagaaacccgttttcgcgatctgccacggcccgcagctgctgattgataccgaccttcttaaaggaaaagatatcacgggattccgcagcatccgcaaagacttaatcaatgccggcgcacattataaagatgaagaagtcatcgtgagccataacatcgtaacgagcagaacgcctgacgatttggaagcctttaatcgtgaatcattgaacctgctgaaataagcgaataaaaatgcacagacccgttcagtctgtgcatttttttatggattgataaagaaacaccaatagttagacctattctcttccccatccataataagtaaaataaagagtgggtttttcaacactcgacgggaggttcacttatgtggatgatcattttgctgctgatcattttaatcggttttaccggtaatatcatttcgcttttgagagcgcaaaaacacgcatctcaaagaataattgagcttttagaaaagcaaggccgaaaataatcatgcagcgctgtgttacccgtaatagtaataataattccggcagatttcctgaaaaatgatttgatgccctttctcgttcggatgaagaccttctgacatgcacatgctgcggaaagcgggattatacgggtcgatgagatctgtatcaaacaggtcggcatacggtacagagaggagtgtgcaggcttctttttgggctttcacatagtcagccagcttcaggcccagtttatttttatcagtatcacggcggacgatttttccttttgatatttttgcttgtctcgttggggtcaccacaatggtgctcgcgcctttatttccgcttcgcagctgctgaatcacttgacagaagcctccgtaaaatgtggtgatatccttttcatctgtgccgatgggaatgtggttgcaccaatcatcatctgttccctggacaatgatgacatcatgtccctttgttttaagcgcttgctgataaatgttatcgcttccgtggttgctcatattaacgccgctgacagacagattggttatttcagcgtctgtccggtctttcagaatgtcaccaaagccgtattccgcgcgcagcccccgggcgacgctgtcacctaagatcgcgatttttgaagccttccgcagcctgcttatgctgatgaagtcaatgctgatatgcccgctgtccgtgatatgcaaaagcttgctgcttatgttttgcgaagagactgtctttccttcagagttataaaattcctcattcagcttcattcggcgtcatcccttcctttttatcctccggcatcttttttgacataaaaaacggacacgaacaaacagcgccatgttgtcagttcagtgtccgcagatgatgataccggatcttttatgcagttctcttgccattatagcagatctccattacttgtaatagagtctgcttcagcatttaaaacagcgcttgcgggtacgtttttgatgtgaccgtctgctgcgggaacggtgtgtccggcgatgcgtccgtcttctgctgcgggaacggtgtgtccggtgatgcgtccgtcttctgctgcgggaacggtgtgtccggtgatgggtccgtcttctgctgcgggagcggtgtgtccggtgatgactccgtcttctgctgcgggaacggtgtgtccgttttctgctgcgggaacggcgcgaacattttttggaaaccggttcttggtataaatactcccctaaaccttctctttccgcaacggcaactccatgttcaatttctttaacagaaatagcgttcaattctgttcacctccctttttctttacaacataacgtatgaaatgtacccctcacgtgtataagcttctctctcatatgagcgagaaatagtcatttatacaacaaaaagacccgtggaaacgggccttttgcaggcattttgcagggaacaaacgcaaacttaagatcgatttatttcttcctctcgctctccggctcggggtgaatcattacctgtgcttgtttgaattcattcgtaatagctctttcaatgcggtcacacaggtcgtgcacgtctttaatcgccacgtgagaggctacgaccaagtgaaaatcaatatactcctgcgggccggagcgtcttgtacgaaaatcgtgaatttcaataaattcctgttgaaatgtttcgataatctttaaaattgttttttcttcctcttccgacaaacgggtatcaatcagcggcgggaatgcttctttcattaacttaaacgcttcatatatgatatacaccgccagcaccatacctataataggatcaagtatgtaccactccgttaaggtaacgaccaaaaggcttgccgctacgcctaatgatgtgtacacgtcagtcagtaaatgcagggcattcgatttcattgccacggaattaaccttttcggcttctctttttacgaacttcgaaacgatcaaattaatgagagccccgcaagcatcacaacgattcccaatacgggcagatgaaccggagccgggttgaccagtttttgaacgcattcatatatcatccaaatccctgccgcaaaaatcagcatcgtctcgatggtccccgacagattctcgacttttccatgaccgtacggatgccctgtatcagccggcttttttgaaatcctgacggagataaaggcgatgaaggcggcgatcaaatctaaaaaagaatgaatggcttctgaaagtatcgcgacagatccggttattatccccaccactattttgagcatgacgaccagggaattgcttataaccgataaaaaagcgattttagaggtgttttccaccgtgatcctcctctttttgacttcttgtatttatcgtatcaaacggcattcgtgtgggtctacggcaacgtttttcacaaaagccatacatgtaactcatcataaactaagttggaaagcgacaaaacaggcgaacctttctttcagcactcaagtcccattgacaagatataaccgcttacattatagtagtttcatgaataaccactacggaggatgtttatggatgatgttctgaaagaattacagaagtttggattttctcaatatgaatgtaaagcatatatcggcttgttgaaacactcgcctgttaccggatatgaaatcagcaaaaggtcaggcgtcccccgctcaatgatctatgaggtattggggaaattagttgataaaggcgctgtccatattgtgccgtctgatccggttacatatgccccgctggccggaaaggaattaatcgaccggctccggcacgatttcgagagctcattcggctaccttgaggaaaagttattggcgctggaaagcgagcaggagatgaatgtcatccgccgcatcagcacaaatgatcatgtcatcaatgagatgaaggaaatgattgaaaaagccgaggaagagttgtggctgtctgtctgggaacagcagattccctttattcaagaagccgctaataaacgcgccgccgaacaattgcccgtcttttcgattgtgttcggccctccggaagtgaagctcggaaatacgacaaatcataatatgtctcctgaagtggcggagaaacggatgggcggaagattaacgatagctgcccgagataataaagaagtcttaatcgccaatttttctccgcagacgaatgcctgggccattaaatcagaagaccccgctctcgttctcgtggccatggaatatatgaggcacgatctgatgttcgcagagcttgtgaaagaagtcggggctgaaaaagttgaaggcctgatgaaacaaaaccattcgttatttcatgtcgtcaccggaaatcggttcatataaatgtgaaccgtattttctttgattttttcattagtcgttatcattataatctctatgaaaggagtataaaaaatgattaatacagaagtgcaaaaaaccgccgtttcccgggaaatgaacgatacgtttttacagggggtgcgggattgtgtgcctacgctgctgggctatatgagcatcggttttgctttcggcatcgtcggggttgcctctcatctaagcattcttgaaatctgtttgttatccttgtgtgtctatgccggcgccgcccaatttattatttgctcgctccttgtttccgggagtccgatttccgccattattttaacgacgtttatcgtcaatctgcgtcaccttctgctgagcctgaccatcgcgccgtatttcacgaaatactctctggcgaaaaatatcggcttcggggctctgcttactgacgaatctttcggagtagcggtgaacaaagcggctcagaacggcaggttatacgataagtggatgaacggcctcaatataaccgcttacatgtgctgggttatttcctgcgtgatgggcgggcttctcggacaatggatatctgatccttacgctctcggcctggactttgctttgcccgctatgtttgcggcgctgcttgtgctgcaattgcagtcgtccgcttcggaaaagctgaagcacagcctctccttaattctctatatgatcatttttatggtcttgttatcgtatttcgtcccgtcacacatcgcggtcatcgtctcaaccgtaattgtggcaacgatcggggtggtgacggacaaatgagcatcagcacacaaatgatctggattatactcggctgcatgattgttacacttgtgccgcgcattgttccgtttatatttgtccggaacattcagatgcctgaattggctttaaaatggctctcctttattccgctttgcattttgacggctctggtaacggaaaacatgattgtgaaaacaaacagcgctttgacctttgattggaaagcaatgatcgttctcatcccgacattgctttgcgcgatgctgacaaaaagcttatccatcacggtcatcacgggagtcgtgctgatggccgccgtcaggctgatatggtgacaatcaaaagcctccattccatagaatggaggctttacctttatgatgtcggattttcttcttccgtctctgattcctcggcttcggcgtttatgctttgctgctgttcccaatgatcccgctgcaatctttctttggcgatggtaaacatgaaattcacggcgcagcaccccttccctgttttgcttatactatgtactgtactcatttccccgtgcagtattcacaaaacataaaaaagcagcctgccgcatggagcggccggactgctttttattttcagtacgtgatcaggaagtattttttctttccgcggcgcagtacggtaaattgatcttcaatgcggtcttccgcagtcagaagatgcccgatgtccgtctggcgctcgccgttaatgtaaacagctccgttttgaatgtcttcgcgggcctgccgttttgaaggcgacagtttagattccactagcacgtctactaaagacagttcttgagagcggtctttttcaaacgaaggtacatctttaaatcctaccttgacgtcttgagcggaaagctctttaatattgccgctgaacagcgcctgggagatatgaacggcctgctcaagcgcttcacggccgtgtacaagaaccgtcacctcttcagcgagacgtttctgcgcttctcttttctcaggagctgtctccgttttttcagcataagcttcaatttcctcttttgacaagaaagtaaagtattttaagtatttgacgacgtcgcggtcatcagtattgatccagaactggtagaattcgtacggcgatgttttttctttatcaagccaaatggcgccgccttccgttttgccgaatttcgtgccgtcagcttttgtgacgagcggaatggtaagaccgaaagctttcgccccttcttcttctgattttctgatcagttcaagaccggccgtgatgttgccccactggtcactgcctccgatttggagtttgcagttcttttctctgtacagattcagaaaatcgtaggattgcaggatcatgtagctgaattccgtgtaagaaattccggtttcaattcttgagcttacagtatctttcgcaagcatgtagttaattccgaagttctttccgacgtcacggagaaattcaatgatgctcagctttccgatccaatcaaagttgttcgctatgacagcggggttttctcctgcctcgaaatctaaaaatcgggaaagctgatttttaattttttgcgaccattcgacaacgatatcctgagtatttaacgtacgctccgcttttttgccgctcggatcgccgatcagtcccgtcgcgccgcctacaagcgcaatcggatggtggcctgcaagctggaaacggcgcagtgtcaatatcggcagaaggtgtccgatgtgcaggctgtcagccgtcgggtcaaaccctgagtataaacggattttttcttcgctcagctgtttattcagtccttcttcatccgtcatttgctggattaagccgcggaatgataaatcctctaataagttagtcattttgtctgctcctttgtttatgaaaataaaaaacgccccttcgtttaaaacgaagggacgatataatcgcggtaccaccctactaataaaaacataaaaaagcttttatcactctttttgataacggaccgtgtccgttctttcactactgaaagccttggaatagctttgttcgcaaaagcggttcatgagtgtattcggcatatcttatgtgctgattttcaccggccatcagctctctggaacaatcagatatcctacttgtctcaatcaaaaccttttcgtatgaagcttactcatttttaacataaataagatacgatgtcaacgccgtctttaatcttccattgtggacaggtcgcctgccggcaggttcagctcccatgccttcagcacacgtctcatgatttttccgctccgtgttttcggaagtttatctttgaattcaatttcccgcggtgcggcatgcgcggcaagcccctgttttacaaagaggcgaatgtcctccttcagctgatcggatggctcatgcccttctctgagcgcgataaacgctttaataatttctccccggacagggtccggctttccgatgacgccggcttcggcaatcgccggatgttcaacaagtttgctttcgacttcaaacgggccgacgcgctcgccggatgtcatgatgacatcatcgactctgccttggaaccaaaaataaccgtcttcatccatataagcagaatctccggaaacataccagccgcccggcataaaataagaatcatatttctctttgttgttccaaatggaatccatcatcgacggccagccctttttaatggcgagatttcccattcggtacggcggaagctcatttccctgattgtcaacgatcgccgcttccactcccggaatcggtttccccattgagcccggcttgatctccatgcaaggataattgcagatgagctgtccgcccgtttctgtcatccaccacgtgtcgtggatgcgcttgccgaatactttatgtccccacttgatgacctcggggttcaaaggttctccgacactcaggacgtgacgaagtgaagtaaggtcaaatttggatgccatttcatctccggcgcccataagcattctgaaagccgtcggagcgctgtaccagacactgacaccgagcttctcaatcgtgccgtaccagttttccggactgaatctgccgccgacgatcacattcgccgctccgttcagccacggcgcaaatatcccgtacaccgtcccggtcacccagcccgggtccgcagtgcaccaataaatatcgtcttctttaagatcaagcacccacttgccggtctggtattgctgaatcatggcttcatgaacgtggagcacacctttgggcgttccggtagatcctgatgtgtagtgaagcaggtagccgtctcttctgtccatccattcaatatcaagtctcgtgctttctccctcagccgctttatcataatgaatgattttatctcccgcttctttgctgccgccgacaatgaaaatatgctcgaggtcgggcaggctgtccgccggaatccgttcggccagttcaggtgtcgtcacgacaacctttgcctggctgttcaacaggcggtctttgacggcgccttccataaacgcttcaaataaagggccggcgatcgcaccgattttaattgcgccgagcatgataaagtacagctccggcgaacgcggcatgaaaataaaaacgcggtcccctttttccacgtttccataccgtctcagtacatttcccgcccggttcgattcctccatcatttctttaaatgtgtatttttcattccgatttgcgtccttgtaatacagcgctactttgttttttcgaaatgattcggcatgacggtcaattgcttcgtacgccgcattcagcttccccgtctgatgccaggaaaactccgcttcgacctctttccaatcgaagctgcggtacgtttcctcataatttcgcagatgataattccccttttccgccggcaacgctttcaaattcatgcaacatcccctttgcttatctatagactaattatagtagatgttcacagttttctcaatttttaaaatataaattacaacactattgaaaacgctttatattttgttatgcttaagagagatgtgtttttattaagaaccgacaggcggtgaatcagtgaaacatcataaaacgtaccattcttcatcaattcagacagcagccggccctctattggtagaagggcccgttcctccaaaggacctagcacagtatgagtttcatgaaggcctgacagcctttcgccttcctcatgaacagcacaaagcgttaatcgagatcgccgggcttcctgaaggtcggatcattatcgccagggacggacagacgattatcggctatgtgacgtatttatatcctgatccgcttgaacggtggtctgacggcaatatggaagatctccttgagctcggggcgatcgaggtcgctcccggctacaggggctgttctgtcggaaaaacgttgctgacagtcagcatgatggatgaacagatggaacgctacatcatcatgacgacggaatattactggcattgggatttaaaaggaatgaaaaaagatgtgtgggaatacagaaagatcatggaaaagatgatgaatgccgggggtcttgtctggtttgcaacggatgaaccggaaatcagctctcatccggccaattgtctgatggcccgcatcggcaggcacgtcagtcaggagtcaattgaacagttcgacaggcttcgtttttatcagcggtttatgtattgactgacatacaaaggggataaaaagatgattgcagaacaaatcatgaaacgggacgtcatcaccgtctcaaaacacgactccattgaaacagccgtccgtaaaatgaaggtatatcatatccgccatctccctgtcatcgacgacgagctgcacgtcaccggtattgtcacagacagagacattaaacaggccggccccggcagcttcgaacaaaaggaacgcggcgcgtttctgacaaacaaagtggagaccattatgaagcggaatgtcatctgcgcccatccgcttgactttgtggaagaaatatccgcttccttttatgagcacggcatcggctgtctgccgattacggtaaatcataagctgacgggcattttaacgaaaaccgacgtgctccggactttcgtcagcctgacaggcgcggcccagccgggatcacaggtggaaatcctggtgacggatatgacaaaaagccttgctgatctcagctgcatgtgccgtgatcttcagctgcaaatcctgagtgtgctcgtctatccccatgattccgccgggtcgaacattctcgtcttccgggtgaagacgatgaatccgctcccttttatccgtgccgttcatgaagccggatacaatgtcttatggccgaaacatttgagggatcagccatgagagacagcgtttttgtttactcgccttcttatcagacgtatcaatttcatcaggatcatccgttcaatcagcagcgcgtgcttttaacatacgatctgcttcaggcggcggacgcgtttgacgatggagacatcgtcaaaccgcgcacggccactaaagaagagctggctctcgttcatacggaggattatatacaggcggtggaacttgcgggtgcgggccggctccctgccgcagaaggagaaagctacggtctcggaacggaagacacccccgtttttgccggcatgcatgaagctgcgtcgcttctggtgggcggcaccttaacggcggcagattatgtcatgacgggacaagccaggcatgcctgcaatttaggaggaggccttcaccacggcttccgcggcagggcgtcaggcttttgtatctataatgacagcgccgtggccatccaatacatccagaagaactacggggcaaaagtgttatacattgatacagacgcccaccacggcgacggcgttcaatttacgttttacgacaggtctgatgtctgcactgtttcttttcacgagaccgggcgttatttatttcccgggacgggacaagtactggaaaaaggaagcgggcaaggctacggctattcttttaacattccgctggacgctttcacagaggacgattcctttctccacgcttacaaaacggccgcctctgaaattgcggctttttttaagccggatgtgattcttacccaaaacggtgcggacgcccattattacgacccattgacacacctgtccaatacaatctccatttatcaggagatcccgcggctcgctcattcattagcccatcaatattgcagcggcagatggatcgcggtcggcggcggcggatacgatatttggagagtcgtcccgagagcatggagccgcatttggcttgagatgaaagggattgatcccggggagcgcataccgcagaaatggattgataaatggcagaagcattccccctgcacgctgcccgctttttggagtgatcctgaacaattatatcctccgattccacgcaaagaagaaatttcagaaaaaaatgcccaaaccgtggaaaaagcactttttgccatccggtctgagcagcggtataaaacaaaataaaaaacgaccttatgaggaggtcgtttttttgatcacgatttctacacggcggttttctttcatatgtccgggacttttgttgtccttcacaggtttcgtatccgcatacccggcagagataaaccgtttggcggaaaagtcttcattcgcggtaaaatactggatcacactcgccgctcttgcagacgacagctcccagttcgacgggaattgataggtggaaatccggcggctgtccgtatggccttctacctgtatgtcattcggaattgtttttaaaagcaccgcgatctgatgcagaaccggctcggcgtttttcagcacatccgcttttcccgtctgaaacagaacggcctcctgcagcacaagaaccactccgcgctcatcgcgcttcgccgtcaatttggaactcaaatgatgcgcttttatgtatgtcttcacgttttgtaacagcaaatcctgttctttattttcgtttgctttgtctgatgacgccggttcacctccgctgccgtttgtatgaatcgatgaaacggcagattgaaatttttccgcgtctatttgcgacatcgaaaaaagcaagataaagaacacgagaatgagcgtgatcaagtcagcgaacgtcaccatccatctcggtgaaccgccggaatgttccggtttgtttcttctttcaaaacgctcttttctaagcttcatggacagcgccctttttcttgttcgcaggctgtcctttacgccagtcttctcttgagctgaagacgacgagctgactttcgaggttgcggggatttttgcccgattggatgccgacaaccccttcgatcatgacctgtttgatgaaaatttcactttccgttttttcttcaagctttgccgcgattgggataaacaccaaattggcaagcagcgctccgtacagcgtcgtcaatagcgcaacggccatgttcggtccgagggtatgcgggtcatttaagtttttgagcatgagaacgagtccgacgagcgtcccgatcattccccaggcgggtgcgaaatcaccagctttttcaaaaacgcgtcttccttttctgtgtctttcttccattgcggcgatctcagaatccatcaccagccggatcgtttcctcgtcccagccgtcaatcgcaagcaaaagccctttttttaaaaacggatccttgatctcccgcgcctggtcatccagagacagcagcccctgcctgcgcgcctgctccgaaaggctgacaaatactctgacaagctctttcacattgtcatcctgacgggagaatacctgtttcagaacagaaggggttttctttaaatccctcggcggaaagctgataaagaccgccgcggcaaggccgcctgtgacgattaaaaaagaagtcagatccaaaaatgaactgattcccgccagtcccgtccctgacagaataccgattgcgacaataatacagcctaacataaagccaacgggcgtcagataatcaaaacgtttcatatcttctccttactcaagtaaaaaagcaagattccacccctcagagtgaagcttgcttttccgtttttttatgacttggttgattgtcttaattcgatgcggtgaggcaattcgacgatatgctcttcaaccggctctttgttcatcagttttgtcaaaagtctcatcgccacggcgccgatatcgtacgtaggctgcacgactgttgaaagctgagggcggaccatcaggctcaatctcgtattgtcaaaaccgataatatcaagatcatcaggtatcgaaagaccttgatcttgggccgcatggataatgccgagggccatttcatccgtcgcagaaagaatcgccgtcggtttccggtcaaggcccatcaagctttgaagcgcctccataccggaatcataagtgtaatcgccttccgctacgaattgctcgttaaacggaatcgccgcttcttcaagcgcccgtttgtacccttgcagttttttcgaacggttgatcggctcttgcatcggtccggagacgaatgcaatatcgcgatgccctttatcaatgaaaagcttaacggcatcataaatcgcctgttcataatcaatggcgacagaaggcgtctcgccctgttcttccactgatgcagccaagacgatcggcacaggagagcgcttaaattcttcgacatgctcgtccgtaatgttgccgcccataaatacgataccgtccacttgtttgccgagcatcgtatttaacagatgcagttctttctcaagattttgatccgagttgcttaagataatattatatttgtacatcgtcgcgatatcttcaattccacgcgcaagttccgagtagaaaatgcttgagatatcagggatgatgacgccgaccgttgtcgtttttttgcttgcaagccctcttgccaccgcgttcgggcggtagccgagccggtcaatggcttccaatactttttttctggtcgtcggttttacattcgggttgccgttcacgacgcgggaaacagtcgccatactgacatttgcttctctggccacatcgtatatcgtaatgttgctcactgaaaccactccttttactggatacacttatccttatctatagcataaacactttatgtaaagaaatgtcgtacgatttcgcattctgtcgtttatgattgtaagcgtaagtcagtagtgtacattatttttcattattcatcaaatttaaatatctctcatgaaattatacacgtttttcccaatgatgaaaacgttcactttcattttataattaaataaaatgaagatacgaaaaaaaagccgcgcgaggcggcctttaaagagcggaacgttgtattatgcttttactttcagcatcggctttaattcgttcagccatttctcgaattcagggatatccatctgctgcgcagagtctgaaagggcaacggaaggatcagggtgtacttcggccatcacgccgtcagcgccgatcgcaagcgccgcttttgctgtcggaagcaggagatcgcggcggcctgttgagtgtgtgacgtcaacaaacaccggcaagtgagtttcctgtttcaaaatcggcacggcagaaatgtcgagtgtgtttctcgttgccgtttcgtacgttctgattccgcgctcacaaagaatgatttggtcgtttccttgtgacatgatgtattcagctgcattgatgaactctgaaattgttgcggcaagaccgcgttttaacaataccggctttttaacggaaccggcggctttcagcaattcaaagttttgcatgttccgcgcgccgatctgaatgacgtcaatgtaatcaatcgcttgctcaatgtgggcgggcgttacgatttcactgatcaccgcgaggtcatattcatcagcgacgcgtttaagaatttgcaggccttctacgccgagaccttggaaatcatacggacttgtgcggggtttaaacgcgcccccgcgcaggattttaatgccttgttttttcgctgcggccgcgacttcggcaacctgctcatagctttctacggcacaaggtccgacgatgaatctctgatcgccgtcaccgattttttcacctttaatgtcaacgatcgtatcttctgcttttttcttccgggagacgagcaacgctttgctgtgatcctcttcttgaagttcaagtccggctttgaaaatttctttgaaaatatgctggatcgttgagttttcaaatgggccgtcattgctttcaataatgcggttaagcattgtacgctctctgacagggtcaaatcggttgacaccctgtgcttcctttgctttaccgatttcttttacaacggctccgcgttcattgattaatttaaggatttctaagtttagtgcgtctgcctgctgtcttagactctctaattccttgttgctcatctttttcatcccttctatgctatgttttattttaatggttaacatgcatcttactacagttatgcgaaaataggaatatgaaataataaattttttcacattcgactttatcacaaaaacgcttttaagcttttatgcgttgaagcagtatatattgatatcctacatgatccggctgaaatgatcaatagtttttttcaaaaaaaaaccgccggtatcaaccggcggccagcaattatgaaaggtgctgctctattgcgttttttgtgatttgtgaatgagacgcgtgccatttcacttcgccgtttgtaataacgaatacttgcgggctttcatgtttcacgccgtatgcctcggcgatatagtttgaaagcggccggctgtcctgcacatgcaggtaataagaaggtacttctgaatgctccgatgcaaaggcgtcaaactcctgaaacgcggcttggctgatcgggcaggttgtgctgtgttttaaaaacacgagcgtgttttctttctcagcggcatttttgaactcttcttcagacgatatcagctgttttgtcatgtcggttatctctccttattgaagatcagcgatttgcctgaccggctttttccccggcgtcttccgcttcggccttgatgctttgggccgtgtcctgcatttcgcttctcgtctcttcggctttctcggttagtgtgctcttagaacggtcttttaaatccttcactttattcataatctgacctgactgatcagctaccagctgggtgatattagatgttttgtccttggcgatgctgacatattgagagcctttttctttcgcgtcggccgtcattctgtccgtcttatcctttaacgcagaagcctgactgccgagatcgtcgcgcagctccttacctgatttaggcgccagaaacaacgccgttgtcgcgccgataattcccccgatcagcgttccgattaaaaaatccttactattgattccatctttgctcattatgattcctccttagtggatttttcttatgattaaagcgatgtttttttcttttgcttccacttgtcccatatttccatagcggcctggctccaggtgacaacctgactgatcttatcctgattctctcttacagaggccgtaacagaacctgctgcctgctttatggatgtattaaactgctggacggaagttcccacttcctggacagcatggacaaccgtatttaatttctctgatttttcctgaatgtcttccgcgagacggtttgtcttatgtaacagctcggttgtctctgcggtaatgcctttcatctgcccttcaaggccgtctaaagtcgaggctacgtttgttaaagtcatctgcacggactttaatgttttggacagatagatgacgaggatgagaaatgcaacggcaatgagtgcgacgcttaagtaaagaatgatgatcatctaatacctccttaatgcaggatatagtggtatatacccaattcttaaaatgataaacatatatgaaaggtctgtatgtatactatttctccgtttatcggtaaatccctttgcagcacgcgcaaaaaagcagtgagagccccactgctttttcgttacgctatgacgttttcataggccctcatatatttttgaatgtctccggcgcccatgaagatcagtactgcgccttcatgcgcttttaacacggaagtgtcattttcttcaatgagttctgcgttatcgattttttcctgaagatccgtgatcgtgagcttgccgacgttctcacgggcagagccgaaaatgtcgcacagatacacgcggtcggccgcgcttaagctttctgcgaattcatccaggaatgattgcgtccgtgtaaacgtatgcggctgaaataccgcgatgatttcacgttcgggatatttttggcgcgccgcctcaatcgtgactttgatttcagtcggatggtgggcgtagtcgtcgatcagtacctggctgccgatcactttttcattgaatctgcgtttgacgccgccgaatgattcaagtccgagcttaatcatgttcacgtctatttcttcatagtggcagagcgcaatgaccgctaaggaattgaggacattatgatggccgtatgccgggatgtagaacgtatcgtaaaacgtattgcggacaaagacgtcaaatgtcgtgccttccgtattttttacgatgtttctcgcttgaaaatcgttttcttctcccgtgccgtaataaacgacaggcacattggcgtgaattttcggcaggtactcgtcatcaccgcaggcaatgatgcctttgttgacttgaagcgccatgttttggaaagcatcaaacacatcgtcaatgttggcgaaataatcagggtggtcaaaatcaatattcgtcataatcgcataatcaggctgatagcttaagaaatgacggcggtactcgcaagcttcaaatacaaagtattcgctgctttcatttcctctgcccgttccgtccccgataagaaacgaagtcggcttcgcctgctgcatcacgtgtgccaagaggcccgttgtggacgtcttgccgtgtgcgcccgttaccgcgacacttgtgtattttttcatatattcagctaaaaatttatgatatctgatgacaggaatcccttcatcgagcgcctttgcaatttccggatgagaatcagggaatgcgtttccggcgattaccgttaagccgggtttgatgttatcggcgctgaacggatagatcgggatatttcttttttcaagggcagcctgagtgaaaatctgcttctcgatatccgatccctgcacctgataccccgtatcatgcaggatttgagcaagcgggctcatacctgtcccttttattccaacaaaatgataaacagtcataatcgtacctccaacaaacgtctatctgttccccagtatatgacgctcatttcattttgcgaccgcagcgggcgaaaagcccgcacagcggcgcttccatttatttttacgttatcgtcagtatctgtaactttctttttgattaaacctgccgcatgatatttcagcgcgtgacagtgatgcagttttgatggtccatccactatcataccatgtttgtgagaaaaatgaacgatattcttattcttgagaaatgtcagcggccgtaatcagcacttcacgcggtttgctgcccttcgcttctgagatcatgccttcggcttccatcatgtcaatcagcctcgcggcgcggttataaccgattctgaaccttctttgaaggcttgaggtgctggcgctgttttgctccacgacgaattggcacgcctcaggaaacagttcgtcttcttccttaagggcggttccctgcctgatcagttcttcctgttcaaacaaataagaaggcggcagctgctttctgacatgagagacgacgcggtcaatctctctgtcggatacaaagttgccctgcaggcgcaccggttttccggtaccgttttcccagtacagcatgtcgccttttccgagcagcttttccgctcccgccatgtcgatgatcgttctggaatctacctggcttgagacggagaatgcaatcctcgtcggtatgttcgccttgatcattccggtaatgacatcgacagacggacgctgtgtcgcgacaagcagatgaatgccgcaggctctcgctttctgcgcgattctggcgatgctttcttccacatcgttcggcgcgaccatcattaaatcggcaagctcatcaatgaccactacgaggtaagggagcttttcgcctgtcttatgatcggccgttaattcattaaagcgtccgatatctctcacacccgaatgggcaaacagttcataccgccgttccatctcttccacaacccattttaacgcggcggtcgcggctttggcgtccgtgatgacggggctgaccaaatgcggaatttggttataaggcgcaagctcgaccattttcggatcaatcagaagcattttgacatcactcggatccgccttataaagcagactgaccaaaatggtattgatgcagacgctttttcccgatcctgtcgcacccgctatcaacccgtgcggcatctttttcaaatcaatgacgaccgggtttccggaaatatcgacaccgagcgcggctgtaagcggagacggattcgtcctgaaagcggcgcttctgatcatctgccttaaatcgacgactttgcttacgcggttcggaacttcaatgccgatcgtgtttttaccggggatcggcgcctcaatccgaatatccttggcagacaggctcagtttaatatcatctgctaagtttgtaattttgtttactttcactccgggctcaggatgcacttcaaaacgtgtgacggacgggccttgtgtgacatgaacgacttgggcgcgcacattaaagtttttcagtgtaacgtttaaaagctcgcgctgttcttcaatccacgattggtcgtcatgtctttgcgccggcggtacgtccagaagcgacagattcggaaagacatagctcgctccgccctctggcgtcttcgtctgcttgtgtttatcgcttttaagcatcatgacgttaaacggaacattgcgctctttcggctgctccgcttttctcacagtctgaggctgtccgtgatgctccgttttttcttcggcaggccgggatggggcatcggtcgtctcaatgcttacaggttcaggctcggggtctgaatgccgctctgcttcattgtactcaggctgagagtctgcttcctgtttcgcgtcgggttcagctgattcgggcttgtcttcagactgcggctgaatttcctcgtatccgggttctgtgtatgtatacaccggttcttctgcggtttcaaaaggcggtgctttttccggctcaggctcctgatgttccccctccggcgccgcttgttcctctgtgttttcagccgttcgggatgcttcagactcaggctctcttataggctgcgggcgggtttgttcatgctcttgttcttctgtaaagccggcagactccgcgctttcggtgtgctccagctcttcagcctgctgcggttctggtgctgcaaacacttgctcttttgcattctcagcctccgtgtgaagctcctcttttttaacggccggaatttcttccgtttcttgtttcgcaaacggttctggccggtcattcgtctgttttgttataccggatgttgtgaagacgggctctttttccgtttcctgaccggattttggcggaacaaattgctcctctgacagcaatgttacgttctcttcacgccgcttttcggaaataggcgcttttttgatgctgtgctgagattgaaagccgtaaaccggtgaaggaatggatgacggtttaaagggctttttcaccgtatcaggctctttatgtgtatgctgtttccgctccgtttgctccttcccggcggcataaccccgggacggctggcggcgttcgtgcctttcccgctgtctttggttttgctccgttcgcttatagccgtccggaacgaccgggaagcggaaattccctttcggatattcgtaatatattttagaatcttccatgcgcgttaatttgccttctggctgatccggtatttgctgtttctggatttgggcatgcgtgttcggttcacgttcatgctcttcttctttttcacctaaaaataagtcaaaaaatttattcagccaactcatgtttaatcactctctaactccctttttagtagtctgggacgatatttagtataccattgccgggcggctcagaaaagattaagctcccaactgaagaaagccgttaagcaggcctgcttaacggctttctctcacatcattcgattctgtgcgcttatttatgggagttagaattgaaatgcttcgccggcctcgcggctgtcttcaagaacaagaatccctttttccgccggcgcatccggcaaagcgagttctttcgcggagcagatcatgccgcttgacggaacgcctcttaattcagcgtctttaatcacaagtccgctcggcattaccgcaccgactttagcgacgacgactttttgccctttgtccacgttcggcgcgccgcaaacgatttgaagggtttcctctccgacattcacttggcagatattcagtttatccgcattcggatgtttttctttcgattcaacgtgaccgacaacaaatttcggagaaaggtcaaccgtcagcgtttctgaaacgccgtttctgttcagtatttcattcacatcctgtacgaaagtctcagacaaagcgacggggccgttgtcttcaatctgtaagtaagaagacacgttaaaaatgttaaagcccgtcgtttcttttgtttctttgttaaagattctgacgacatcgccttctctttcatagccgatttcttcgcgtgctgcatctttaagagagatcagaagcgtatctcccacaccttctttattgtaaaaagcgttcataagaaaaatcctttctaatcctttttcggccggcttttcgccatgataaacacaggttccagtctgccttcattatacagaaatgaaagggccgtaatcggcaccgtgccgcttgcaaagaagctcatggacatttgccctaaaatatcataacccgattcatttcgaatgtcagcaagtattaatacatcctgatgcgggacggaaatcgccaattcgccttcagcggcctgcttatattcatgaagaatcgaatcattgagaatccggctggcgtcatagccgtcattcgccctgaaaaaataaaaataattatccgcaaccgtatcctgtttcacgaccgaaggaagagagcggagattgaatgacgccgtctccctgatccgttcttttgtccagttttctttctcgagcatacggctgtcaattaggcggtacgtcttgccgaggtcaagcgcgtagtagattctcgtttcggccgtatggtcatcatacacgagcggaatgccgtcgctcgtttgatcgggaaatgacgtggagcggatgaccggatagattccggcttcctttccggacatctcctgtccgcttccttccatcgcctccatcgcttctgacacatagtagacgatttcgtcgatcgcttcttcttttttcgtctcccacttcgcaatgatcggcgggagctccaatgtgatgccttttttggtcgtttgatcctcaacacggagggtgtctttttctctgtcaaaaaagaaggatcggttctcgtgctgcaggcgctgttttaataaatccgccagcttccttgacgtcattttcaaagcccgtggcctcctttatgctttagcaagggaatcggttaaaaattgctcaatttcttcttttgttttacggtctttgctgacgaagcggttcacttcttttcctccgttaaacacaacaaagctcggaatgccgtaaatttcccattccgcgcatgtatcaataaattgatcgcggtctacgtagtaataagtgaattcaggaaagtccgcttccagctcagggagaaacggctccacaaagcggcagtccgggcaccaatccgctgaaaacataaataccgcccaatcgtcttgtaccgctttttgcaattcttccgtgctttcaatctttttcattgtcattcctccatctggattatgagttttttatatgctgatgtttgtccaattggatcataccagactgtttacggcaagaccaactatatgcaatatcattatcatatttcatttgcattatcaagcaagtttcgtttaccattttgcttgtagccgtacgaaaatctgaatatgtacataaggaggggcaaaagatgcagtttgtcgtgtatttagcgggtgaaatccacagtgattggcgggatgaaatcaaacaaaaagcaaaagcgctgaacctgccgattacgtttgtcggtccgatggaaaaccatgaacgctcagacaatatcggagaagagattatgggcgtgcagcccgattctgttttaaaagacgccagagcttctgatatcaacaatttccgtacagaggtgctgatggaaaaagccgattttgtgatcgccctgtttggcgagaaatataaacagtggaataccgcgatggatgcttcttatgccatcgcaaaaggaaagccgctcattctcatccgtccgaaagaacttcatcatccgctgaaagagctttccggaaaagcgaatatcacggtcgaaaccgtcaatcaagcgatgaaagcactctcttatttatttgaaacagaataagcaggccgcttttatgcggtcctgcttacctacactcaccacttcagtattaatcagttcaagaggaaagtttatatttgtcttttttgtcataatcataccttcttgcagaacaaataaaaatgcaaatgactcgactttgtgaaatcgctgctcctctcaatgcttgcagcatgtttttgatttaaaaacgtttatcattgcaataaaggttcgaaggttgtttatctggatcggaaccattttgataataatattgaaaaataatatgtgttacctaattctatttacaatacgctttacacttatattcacaacaaagaactgtctcgatcatgcggcttaaaacagaatgtaaaaacagcagtcaataagtattcaaagggacttattgactgcttattttttttacacattttctctgatcgtttcgaccgtctgtttgtcactcgccatgaccagcttaatgagcatttctttcgccgcggcataatcatcgacatggatgatagcggcatttgtatgaatgtatcttgaacaaatgccgatgacggcagacggaaccccgctgtttgatatgtggacgcgtccggcatccgttcctccgcctgaagcgaaatattgataagggatattgtgcgtttccgccatatcaaggacgaactctctcatcccgcggtgcatgaccgtcgttctgtcgagaatgcggagcagcaccccctcgccgagacggccgaacagctccttatcgccgctcatatcatttgccgggctggcatcaagcgcgaagaagagatcaggctgaatcatgttggccgctgtctgcgcccctctcaagccgacttcctcctgaacggtggccccggcgtacagattgttcggcaggtcttttccgtgcagctcttttaatagttcaatgcttaacccgcagccgtagcggttatcccacgctttggacaatattttcttctcgttggccatcggggtgaacgggcagaccggcacgacctgctgtcccggtctgatccccattttgaccgcgtcctctctgtcatcggcaccgatatcaatcatcatatttttgatctccatcggctttgcgcgctgggcatccgttaaaatgtggggcgggatgcttgagatgacgccgataatcggtccgttatccgtctgcacctcgacacgctgggcaagcagcacctggctccaccagccgccgagcgtctgaaatctcagcatgccgttatccgtaatctgtgtcaccataaacccgacttcatccatatgcccggctaccataacggtcggcgcatcttcagcgccgcgccttactccgaaaacacttccgagtctgtcctgcacgatgtcatccgcatatttcgcaagctcccgtttcataaaagagcggacctgatgttcatttcccggtgcgccgggaagctgcgtcagcgtccggaaaagcgttttcgtttcctcattcatattttcccctcatttctatgtaatgcttttattttattagaaaaacaaccgttttccaagcgctcagattgaatgggctgtaaaaccgccgctttacttaacaccgtctggcatcttctgtataataaaaactacgacataattggaggtgcttcatattgaaattacgtcattttctcttaggtgcaggagtcggattatgcgctgccatcgcagtgaaaaagtatgcgatgaaaccttatatctcttcagaaaaagcgctccgtatcgtgaaagcggcttttaaacagcgcgggccgatagacggatcatggatttacacagagccggagccctaccaggtaaacggagaaaccatccaggtatacaaaaccggcgtgacacgttcggcattcggcgaactggagcaatatgaagttatggtcaatgcaaaaacaggccagattgtcgatgtcattgattctgtcgcctcataattcggacaagcaaaaaataaagcccaaaaccatcagcgttttgggctttattcggttacatcggccgaattcgtttatatacggggttccacatcgcgtcctgaaccgcttggatcagatcctcgggttccgtttccgctacaccgtcctgaatcgcagctttagctacagctaccgccacggttgccgataccgtcctgagatcctccactttcggaagcatcggcgcgcccggcttgccgacgtccaccataccggcgatggcattcgcgcaggcaacgaacatattgtccgtaatgagccttgcttttgtcacaatcgttccgagcccgagtcccgggaatacgagcgcgttgttcgcctgtccgatatggtaggtaacgccgttatacgcaacaggcgggaacggacttcccgttgtgacaagcgcgcggccttccgtccatttaattaaatcttcaggttttgcttctgataatgtcgtcgggtttgacataggcaaaatagccggccgtttgacatgtgaggccatttctttgacgatttcttccgtaaatgcgcctgaaacggtagatgtgccgatcaggatcgtcggcttggcctgtcgcaccgtctccgccagatcaattgatccgccttcaccgctgcggccgtactctttcacttcatcagcagggcgggcgtacggaacctgaaaatcacgcaagtccttcatatcatccgtcaacaatccgtttctgtcgatacaccaaaagcggctgtatgattcttcttcgcttaatccgttatgcaccatagcttcgcgcagctgctcagcaattccgataccggccgttcccgcgccgaagacgacgactttatgctcttttaaaggcacttttgatgctttcgcacacgctaaaacagctgcaagcgacaccgcgcctgttccttgaatgtcatcgttaaacgtacagactttatctttataccgttttaatatgccgcgggcgttagccgtgccgaaatcctcccaatgaagcagcgcattcgggaatgtttcccgggcaagcgagacatactcatcaataaagcggtcatatttctcgccgcgcactcttgaatgttggtttccgacatacagcgggtcatttaagaggctttcttgatttgtccccgcgtccaaaacgaccgcaagcactcgtgacggatcaattccggcggccgccgtatacaccgcgagttttccgacagaaatggcgatgccgccgacgccccagtcaccgattcccagaatgccctccgcatctgtcgcaacgatcaagtcaatgttttcattttttccgaactgctgaaatgcggcgcgcattccttcagggtcatctattgacaaatacagaccgcggggttttctgtactcgtggctgtaacgctggatcgcggtgccgacggtcggcgtatatacgatcggcagcatttcgcctaaatgatcatttaacagcctgtaaaataatgtttcattccgatcatggagagcggtcaagtacacatttttgctcagctcatcaggctgcgaactgaattgttcgtaggcccgcctcgcctgctcttcgattgtcaatactttcggcggcagaaatccctcgagcccgagttcctttctttcctcctgtgtaaaggccacccctttatttaaaaaaggcgtagaaagcacttctaatccgcgcagagttgttttgatttctccatctttcgtcacttgaaattgattcacctgtctcttcctttcaaagcaatttgtcttaggtttgcttttattcccgaaattcatacaggtaaatcatcgatccgcttattttctctcccgtttgacagatgcagccacttcgccgtcttctccccattttaccgctctgtaaatcgcgtcgtgatagaaaatcagccaggcgcctttttctgccgcgaacgtctgccatttctgcttttgcggaatggaggtcatcggataatcatcataggccagcacccataacggatttttatgcgcattcgtcggcatcaggtcggcaaaatgcacagccgtctccccgccgtcttctaagacgatgacactgtggccgtcgctgtggcctccggtgtggtgcatcgtaatgccttctgtcagctgatactcgttctcaaaggtttcgacctgatcttgtaccgcctcccaattttctctccaatatgtatttttcgatctgatattagggtttctcatttcgcgccactctgttgcagaagtgataatgcgggcattcgggaaaacagagacaagctcctctccgctgtattccgtcaagccgcatgcatggtcaaaatgaagatgggtcatcgccgcaatatgaatgtcctcacaggaaagcccgagttcacgaagagagtgttttaaattggattcctgtgttacaccgtaattccttttttgtttatcagaaaatttccctctgccgatacccgcgtcaaccaatatattcaggccgtttgttctgatcagaatcgggtctgttcttaattcaatctggtttttgtcatttacggggtattttctcgaccataaaggcttcgggacaacgccgaacatcgctccgccgtccatatgtgttacaccgccgtccagccatgttaatgaaatattcccaatattcaatgtctccatcttgatccctcctgatataatggtagcaaatggcggcataaaaaaacagactcccgcatcagagtctgtcttttgttctccattcaacttcggcccggtaaatcggctggccgagtgcggagaatttttcttcgtattctgtcataatattgcccttcggatcgctgttgtgcagatctaggctgacttctgtcagaagcaggccgtattcggaaaagcttttcagagagtattcgaataaaccgcggttatcggttttgaaatgaatctcacctgtttcgcccatcacttcttcgtattttttcaagaacgttttaaatgttaaacggcgcttttcgtgacggtttttcggccacgggtcagaaaagtttaaataaacgcgcttgatttctccccgttcaaatacgtcattcagtgtttccgcgtctatatttaacaaacggacattatgagccccgctgtcctttactttttggacggcagtgacgatgacgcttttaaacagctcaattccgatatagttgatatccggattctgcttggccattcctgaaatgaactgcccttttcccgtaccgacttcaatatggatcgggttgtcattgccaaagaccgtattccaccgccctttatactgggccggatcactgatggcgatgtcagcgttttctgccagaaaatcattcgcccaaggtttatggcgcattctcatatgattgacacctctatctataatttcgagtaacaacataccatgaaacataaagagccgcaagcgccttttaaaggcgccggccgcataaaaaaagaggctccccggtccggaacactcatgtgatgcataaaaccgcaccgctttgcacaatgtatgacacagaaaggatgtgtatatgaatcatgggcttaacaagcgaacatcaggtccggttattaaaggacatattggccgaccatcaattggattgctgcggcacggttgccgagtatgaacagctggagcgcgtcatcaaatcactgatggccaacaccgggcttgattcaaatataaaaaacgtgctcgaggatgtctaccgctacagccagtccggcatcacggccgattccatcgacacgcatattcaggagcaccaaaaccatttgtcccaatgggtggagcagatggattcgtactcctgactacttgacaatccgcttcatcagggcatgaagctcttccatggcatcatgatacgctttgtcgtttccttttgatttgtgccaggcgatgaaggtgatggtctccgataacatgtaccacgccatccgcagccgaagcccttccgtgagcttcatgccgtacatcccaagccagctgtcccacgctggctcttcgacgtaatgatacaataaagggccgagatccatggccggatcggctatcatggcgccgtcccaatctattaaatacagctggttgtcttcagacagaagccagttattatgattcacatcacaatggcaaacgactttttcaccgaattgcacctgatccacatgagcttccaaataagcaaggccttcctgaataagcggcgaaaattgccgcacggcaaagacggcctgcttcagctgcgacaaaagggcgcccggatcaagcggttcttttcccaatcttttcagcatgtcgagcaaagcttttgatgtgtggattttgcggagcagctcagccaccgggcgtccgctcatatcctttgccttcagctccctgcccgccatccaatgctgagccgtaatgacgtctccgttttccatccgttttgtccaaaccagcttcggaacaatgccttcggcggataacacggctaaaaagggcgagctattacgttttaaaaaaagctgttggccgttatgtttcgcataatatgcatctcctgtagctcctccggcggggaagatctcccaatcgctacctagtaattgtcccaaccagttcatatcaatgttcaacccatcatttcttaaaatattttagaataggcctccagcctttctctattggcggagcggcctgtcataaacaatttcatgagaataaaaaagacagctattgagagtctcatatgctaatcaatagccgtcctataaattttagcgctacagcacaaacttcgtcaagcaaaactagcaagaacacctgtgaattctgaagatttatgccgcgaaccgctctgttgccgtgaaacaattgacgggtttcatttgtttattatgtttttattttcaatggcgcaccgcccggcataagccgaaacggcgtcgttccgatcagctcgccgtcagcgtgaaacggaattttcccatctgtttcaaaaacgaattccttcccctttatcatcgtcactccgtccattttgatatgccggccgaagctcatcgcccataaaaaacgatacagcgaaaaaaaggacaggttttctgcaatgacaatatcaaaatagttttgacggggatttgctgaaggcgccgctttcatgccgcctccgtaataagggtgattagccgcaataacaaaccagacattgcggaattcacgtctctggccgtctgccgtgcaaacaaatctgaacggctgaaaccccgaggccgtatgtaaatgcgcgagcgggtaaatcacaaagccgagacgcaaaaaccgaagaacgcgcgaaaacggaaaattcgcggctgccttcaaaactgaggcatcgaagccgacagacaggtggttaataaaatagagtgattgcgctttgtcatgaaaaaagttgatgtttcccgcaaaaaatttccgtgtgagcgggcggtgcagacttttgatttcttggaggagcgccgacttcttaataccgagccctttggaaaagtcattgtacgaaccggcgggcacaaaggtcagctcaatctgatccgttcctttcagtccgttaatgacttcatgcatcgtcccgtcaccgccgatgacgaacagccgcttaagcttatgatcctgcatcattgaaatctgtcttgccagcacctccgcatgtccgggatgcccggtcaaaaaagagcggtggctgaccccgcgcctggtcagctctttttgaactgatttccagacacgccggccccgcccgcctcctgagaccggattaataataaaaaaccattgactcatcgtttgttttcacctgcttcatagatgaagagacagccggcaaacgtccgctttaatcaagccattcctgtctccggcttgaatcgctcaagccgtaagacaaaagagccttcgccgccttcagctggtggtgcttgatcggcgccgtatttttctgctgcttttccagccaccctgccgcagtccgtttatcagctatttccagcccgtacggcggctccgggtaatcaatataagacgttctgctgagcaaaagcttccgcacgggaatgtcggcctgcttttcttttacgatttgcgaaacgaccgagcccgtccggtgcaggctgagagacggattcaatacttggcgcgtgctgccggagcctctttcttcccaaaaacggtgttttgatccgatatatacactgtcctcttccgcttccataaaagcggcgcagaaaatctccagcggcgagatgatgataatgctcagttcgacggacgcctgctgaatttgcagaaccggatgatacatcacaaaataggaatcgggcagtttttgagccagcatttttaacatcctgtcccttttgaccgcctgcgaaagctcagacttttgagaaagcgtggagctcgcccattttaattgaaagtcatacagctgatctttgaaaaaaggcgcgagctcagacttttgagacggaagattcccgaacagcgcctcttctccctccggttcatcaaaccattggtgcctcttttcatttatatcggccgtattttcttcttttctcttttttaaggaaaattttttcctggccggcgcttgatcggtttccccgccggcagccgtttccgtttcttccgttatccggtcaaacgcttcaagaagcgcctcccagcgttctttcttcagccggataaactggttcatataatggtatggatcaagttcatatctggatatgcagtcgtgaattttgatgatctgtgccatgtgatttctccactccgaatatttgtttatgtcaattgaaactgtgcgatttcttcgtatttaggcgaccggtcaagatgggtctgaaacagggaaaacctgctgacggcactttgcaccctgccgctttcaaacggcacatcgtcagaaaacggccggtctcccgcccacttccgcgccatcgtcatatgagggtgatacggccgtttttccacttgaaaaccggctttcaaaacagcctgttttgttttttcccgcaaatcaaagagcagttcattccgttcgggctcaaggtgaagcactctcggctgtctgcggtcgccgaaaatatccagatgctgaaactgtacggtaaacggctgcgctgccgacgcagcatctgcgagcagagacgataatttcgcaagccgttcttcatccgcggctccgagaaaaatgagcgtaatatgatagtcatgcgggtgcacccattttttgaatgataacgccggctcctttttggctgcttcccaaatcggttcagcaatgtcagccggaatcggaatgccgataaaataatgcggcaatgaagctttcatacgaggatctccccctctttggttatggtgttattataaaacggataagcggagaggagaaccctgtccgctcattatgataggatattatgtaccgaacgttttatacagaaaggaatgagccggccttgaaaatcgtaaacagcacggcggagctgatcggcggcacaccgatcgtaaagctcaatcgccttcagccagaacatgcagcacaggtctatttaaaattagaatcgtttaacccgagcggcagtgtcaaagacagagcggcttacaatatgatcattgaagcggaaaacagcgggcatttaaaacccggctctgtcatcatcgaaccgacaagcggcaacacaggcatcggcctggcgatgaacgcggcggcgcgcggctacaaggcaatcctcgtcatgcctgacacgatgacgaaagaacgcatcaacctcctgaaagcgtacggcgcggaggttgtgttaacaccgggggcggaaagaatgcccggcagcatcaaaaaagcgaaagaactcgccgaacagattccgggaagttttatcccgatgcaattcgataacggcgcaaatccagatgcccaccgaaaaacgaccgccattgaaatctatcaggccgttcagcagctcaacagaccgctcggtgcttttgtggcaacggcgggaacgggcgggaccattaccggaaccggagaaacgctgaaagagcttttcccggatatgattgttcatgtcgccgagcctgcgggatctcccgtcctgtctggcggaaaacccggcgctcataagcttgtcgggacaagccccggatttattcccggcatactgaatcaggacgtttacgatgaaatcatgaaaatatctgatgaagatgcgtatacgacaacacgtcgtctggcccgggaagaaggcatactcgtcggcccgtcttcaggcgccgcctgcttcgccgccattgaaaccgccaaacgcctccctcccgaacagatcgtcatctgtatgacggccgatacgggagaacgttatttatccacggatttatggtcatttgaatgataaaaagggatgccgctttcggcgtccctttttattatcacttggcaagttcataaatggcttcggcatataaagccgttgacctgagaaggtcatcgatttcaatgtactcatccttttgatgcgcgctgtcaggccggccggggaacagcggaccgaacgcgacgcccgccgaaagggatctcgcatacgttcctccgccgattgaaatcagatccgctttctttcccgtctgtccttcgtaaaccttttgaagcgtctttacgagcggatgatcggcagaaacgtggtgcggtttgctgtctttaaattcttcaagccggaattcttcagcagacgtaaaagcatcacggatgactttgctgtctgaagtgacgggataacggatgttgatgccgagttctccatcctcaccctttctgtatgtaaaggtgccgacattcaatgtaagctctccgctgatgtcatccctgcaatcaattttcagctttttgcctcgtgtatcatttaaaaaatagtcactgacggttttgacaaagtgctttccggctccatccagctctgttccgttaaggcattcagcaagctttaagccggcattgataccattatccggttccatcgcgtggcatgatttcccgtatacccgaagcgtcagttttccattttccgaaactgcttcaccttgtgtttttgactgctcaagccatttgctgaaatatgcgtgcacggcatcaataccgttcccttcaataaccgcttcagccgcatccggcaccatgttcaagcgcagtcctgaacggaatgacagaagcacgttttttgcgtctttgtcagaagcgttttttacaatgcgcagtgacgcatctataattcctttttccgcgttaatgatcggaaaatctgcgtcaggagcaaagccgatgtcaggcattttttcgtgtttgaagtagtgatccacgcatctccaatcactttcttcatccgttccgatgatgattctcacgcgtttggataaaggaagctgcatgtctttgacgattttcagcgcataaaacgccgccattgtcggccctttatcatcaatggcgcctctggcatatatccggccgtccctgatatcggctgaaaacggatcgctcgtccagccgtctccgggcggaacgacatcgacgtggcacaaaacaccgacgatttcgtcacccgttccccattcaatatggcccgcatagccgtcaagattctttacggtgaagccttcttttttaccgaattccagcagtgacgccaggctggcattgacgccttctccaaacggccggccgggaccggctgttgattcgtccattacgctgttgatctgcaaaaacttctgcgtgtcacggatcagatcttctttgtttctgatgacttcaacttcccagttcatcacaaatcccctttcttgataaagacttgcaaaatgtcgataaaacgaataatatagatgatgttttgaaaaaatgttcgtcattggaggtacttatgtttcatctcgacaagcatcaaacgacaataaaaagagaaattaccgcgggattgaccacctttttcacaatggtgtatatcattgtcgtcaatccggtgatcctttccaatgcgggaattccgtttgaccaggtgttcaccgcgacgattatcgcttccattgtcggaactttatggatggctctcgctgcgaattttccgatcgccattgcccccggcatgggcttaaacgcgtatctcgcctttcacgttgtcggcacaggcagcggcattacgtatcagacggctttcagcgccgtttttatcgcgggagtcatctttattattttatcgttaacgcctttaagaaaacaacttatagaagcgattccggacaatttaaaatacggaattacgaccggcatcggcttatttatcgcttttatcggcttacgccaatccggaatcatcacggctgataaatccaatctggtcgcactcggcgatcttcattcgcccgccgtcattttaacgcttatcggacttatcatcagtatcgtgctgatggtgctgaatgtaaacggcgctctgttcatcggaatggcgctgaccgccgtcattgcctttttgaccggacagatccattttgcgaaagggttcatttcatttccgcgcctgccggaggggcttttaatcacaaatccgttcggtgccctcggggatgtcgtgcatcacggtctgtacgccgttgtgttttcttttcttctcgttacgatttttgacacgaccggcaccatgatcggtgtcgctgaacaagcgggattgatcaaaaacaatcagctgccgaatgccagaagagcgctgttggctgattcaacggctacgacggtgggaagcatcttcggcaccagcccgacgaccgcgttcgttgaatcttcagcaggtgtggccgccggcggaagaacaggtctgacggcgctgacgattgccgttatgtttgccgtttccatgtttttcagcccgcttgtcagcgtcttatcggaagtgtccgcgattacgtcaccggctctgattattgtcggcagcctgatgatgggtgctgtgtcgaatatccgctggaatgagcttgacgaagcgttcccggcctttctcgtcattttggcgatgcctttaacgtccagtatttcaaccggaatcgcactcggcttcatttcatatccgcttgttaaagcagctaagaaaaaatggcgcgaaatccatcctctagtcctcatcttcgccgtgctgttttttattcagctttttattttgaacggacattaagaaaaatccctttccttttcggaaagggatttttacatataaagaacggaaagaatcgcggcaatgagacaccaggcggaacagatgatttgaatgacggttaatgcactgtttcgcgcccggaaatagtcatcactgtctctcttgataccgcttaaaaccggtttatccgtgatccggtcaaataaaagtgacgcggcatagcggctgacgatcgcaaataaaataaggactgccggcttcactaagagcggaagaacgagaataagagccgtaaaagccgcggttaaaaggtaaagctgccggagatacccgccgtttcggatcagcactttaaaaaacaattctttccacgccgtatacgccgaccgttttgtaaagatgtgctttgagccgggatataaaaacggcttgctccgccctttatttttaccattcgggagctgcacatcatggctgagcatcaaaactgaggcggcgagtgaaagcttccgcctgttctcctcaagcacttcttcctcaaaggctgataatgtctccgtccctttccaagtcaaaaaagcggaacagatgaacaatatacatcccgccggccaaagccaataccattcggcggcaaaggtgatcataaaaaacgcacccgccgtcagaaccatcactttcagccagcccgccgcctgattcccgaatgtccgcctgctgttttttctgtgccggtgcaccgctaatatcgcggtatggaagccgaacagacagcaaaacatacctgaatatgccggtaaggtacagtcaccgtactggcgccataagggaaataacaatacggcaagcgcaccccatttgataagggaaaggaacatcgaatacaaaagcgcgtaccgtttcagcttttgcatcagatgttttgcatgcaccaaaaacacgtgatccgcttccagcaaaaaggtatgaataaaacccgtgcacaacagcaaggcactgaatacatacagccagccccatcctaatactcctgccgctccattaagaagccccctgccgttcagccattcagcatattgataaacggcaaatgcggcagcgggaagaacgatgtacagcgcgaccgtccaatcaatgaccgtctgaaacaccttccattgataccgccaataatgaaacagcctttgaaaaaacaaagcccgcccggtcatcgctgactgctccgaaccgctgaataaaagcaatccagcagtgaacggctccccgttttttcctgaagctcctctaacgtgccttgaagaagcagagcgccctgatccagcaaataaaaccggtcgcagattttttccgccgtatccagaacatgcgtgcacatcaaaattcccgcgcccctttctttctcagcaatcagcatgtcggtaaacagcttcgttgagatcggatcaagtccgataaaaggctcatcaatgatgtaaatatccggcttcgccaaaaatgcctgtataagcatcatcttttgctgcatcccttttgaaaaaccggaaggcaaatcatgttttacagacgtcagcgaaaactcttcaagcagccgccctgcccgctcacggcactcttccccttctataccccgcaatgacccggtcagctcgaggtgctcccaaagcgtcagttcatcgtaaaaactcggccgctccggtatgtaagcataagatgaatcattccactcaataccgccttcaatatcccgggacagcccgagaaccgcctttatcactgtacttttccccgcgccgttcgctccgattaaaccggcaatttcaccagcgttgactgacagagatacatcggaaatcaccttcggcctgtcagcataaccggcgcagacaatgtttgcattcaataattctcccaaacttctcactcccccgctttcatacggacatgtataaaaaaagtttcagtttccataatattaaaagcggtccggacatagtaatgcaccaaggctgcacccatttggaaaaaattatctgcgcttattcctagattcatgtcgtccatatcgtgtataatggaggcagttaaaagagaaaaaaaacagaatgtcatcctttgttgcttattcgtacgaagttttagagtcgaaagttgtggtatatcaagtccatccgatcttatgatagggagtggttttttgaaaccttcaacaaatcgtatgctgactcggattaaatcagtttacatgttcatccaggaaaaaggccttgtgacaacacaggaactggttgatgaattcggcattacacctagaaccattcagcgagacttaaatgtgttagcatacaatgatcttgttcatagtcctagccgaggcaagtgggagacaacacgaaaaaaagtgaaaattacatcttaagcgaacaattacataaggcccttttcggcctgacatgctgcaaggcaaagcagcgtctttgccttgttttttgttcctctatataaaaagcccaaaacaaatctgttttgggcttttctgatatcgattacacttcagcgcctctcagcgtttcgagctcctcttcagtcagctcgcggaattctcccggtttaagatccgggtcaagagaaacagcccccatcgaaagccgcttcaaataagccacttcatttccgacagcctttgccatcagcttcacctgatgatatttgccttctgtaatggtcaagtgaatcaccgtttcatccgggttttctgtaatgatttcaacggctgccggcttcgtcttatagcctccttcaatgacgacgcctctttccagatgaacgatgtcttccgatgccagaggtgaagttaaccggacctcatatgttttaggcacatgctttttcggagaaagcaggcgatgagcgagctgcccgtcattggtgagaagcaaaaagccttccgtatccttatcaagacgtcccgccggaaacggttcaaatcgctgttcttcaggcgtcagcagatcaaccaccgtttgctggcggctgtcttctgtagcggacagcactccttgcggcttattcatcatgacataaataaattcacgatagtctgccggctctccgtataccgtgatgtcctgtttttccggatcgacatgggttttcacatctttcgccggctctccgtcaatcatgacagccccggccttgacgatttttttcacatcttttcttgagccgaatccgctgttggcaagcagcttatcaagtctcatcctgatcctctcctttaaaaagaaaagcccgcgataagcggactattcattatttctcaatgggcggaatgcctgcctctcctcaaaacgcggggcagacggtttccaaacattttctgtaaaaatccgattcggtacgcggcaaacatgtacaccgcaccgccgacagcggcgcagacaaagacgacaatcgccgcatgcacctggccgctttggtatgttacaaagaaactgagcagccattgagtcagcttgaccgcgactcccatcacgacggacaggactgcgattaaaatgacccgttttataagtaccgtatacgaatagcccgcatggcgcttaatcatgataaaaccgtacagaagagaagcgatataaccgagcgccgttgccaagatggccccgtctccctgaaacagcttgatcagcggcacgttcagcaccacttttataatgacgccgatgaaaaggctcacgacagcaaatttctgcttattaatcccttgcaggatcgcggcgtttacggtaaacagagaaaacagaatcgcgacaggcgcgtaccagaacaatatatcctgtccgatatccgggcgaagactttcagagccgtagaagaacgtataggccggacccgataacacggacatcccgacaacggcgggaataaccaaaaacagaataatttgcatcgtctggttaatctgctgattcaaaagcttataattcctgctcgtaaacgattcagtaatcgtcggaatcagcgtcagaccgaaagcggtcgccagagaaaccgggatcatcacaagcttcggcacataaagggtgacaatcgcaagcatgtcctggctgatatccttatggcccgccgcaatcatcgctttattaaacgtattcgtatcgatatatgaatacaaaggaatcgccagtccgacaaatacgtaaggagcggcataactgaaaagctcaatgaacatttttttataacttaagttcgcagacgggacgagattcggcttcatcgccagaagatcgcccttccgcttattccagtaaatataaaggacgacaagccctccgaatgatccgatcagcgccgcgaaagtcgcgtatccgactgcgatgacaaggccgccgttgatcactcttaaaatcaaatacgttgcgcccaataaaaagatgatccgggcaagctgctccacaacctgtgaaacggctgtgggccccatcatctgatgaccttggaaaaaaccgcgcacaaggctcataatcggcacgaccaaaagtgccagactgaccatccggatgacataaacgacgtggtcaatcgtaagtccgttgttactcgtgccgccgagagatgtttccgcaaaaaacggcgccgaaatataaagaattgaaaaagcgatcatcccggttacgagcataaccgacattcccgctctcagcatccgcctgctcgtctcatagtctcctttggagttatatttcgagacaaattttgaaaccgcggcgggaaatcccatcgtggcaatgtttaaaaacagtgtatattgattatatccgtattgaaacaaagctccgcccgtcgctccgaccatcgctccgaacgggatcagataaatcatccctaaaatccgcgatatataggtgccgagcgtcagcacgaacgtgccccttaacaatttgcttgacatgtttcctcatcaccattttctacgaagattcaacttttctattttaacacaactgggcaattagacggtaataattacagcgggaaactttttgggaaagctcttaaaaacaaaatacgtttaaggaatccccttctttcgctataatagcaggaagcggacatttccgcctattatacgtgaaaaagaaagttgttgatgaaatatgaaacattatgacgtaattgtgatcggcggcggcccgtccggtttaatggctgcgattgcggcaggcgaagaaggggcggacgtattattaatcgataaaggaaacaagctgggacggaagctggcgatttccggcggcgggcgctgcaacgtgaccaaccgcctccccgttgaagaaatcattaaacacatccccggcaacggccgctttttatacagcgcgttttccgaatttaataatgaagatatcatcgccttttttgaaaaactcggcattcagctgaaagaagaagaccacgggcgcatgttcccggtgacggacaaagcccaaagcgttgtcgatgcgcttttgaaccgattaaaacaactgaatgtcaccatccgcacaaatgaaaaaatcaaagaggtgcggtacgagaacggcaggacagcgggcattacgacaaacaatgacgaacacattaacgcagacgccgtcattatcgcggtcggcggaaaatcagtcccgcataccggcagcaccggagacggctatgcatgggcggaagcggccggtcataccgtgaccgaactctttccgacggaagtgccggttacgtcgtcagaaccgtttattaaacaaaaaacacttcaggggctgtcccttagaaacgcggccgtcagcgtcctgaataaaaaaggcaaacctattgtcacacacgtgatggacatgctgtttacccatttcggcttgtcaggccccgccattctccgctgcagccagtttgtcgtcaaagaactgaaaaagcagcccgatgtcaaattacgcatcgatctgtttcccggcatcaacgaggaagagttatttcaaaagatgcacaaggaactgaaagacgcaccgaaaaaagcgctcaaaaacgcactgaagccgtggatgcaggaacggtatctgctttttcttctggaacggaacggtcttgatccgcagacaagctttacggaactgccgaaggatcaattcagggcttttgtcaaagactgcaaacaatttacggttgccgctgacggaacgctttctttggacaaagcgtttgtcacaggcggaggtgtttccgtaaaagagattgagccgaaacaaatggcgtctaaaaaaatggaaggcttatatttttgcggagaaatactcgacattcacggttataccgggggctacaatatcacttcagcctttgtcacggggcgtctcgccggtttgaatgcaggacgtttctcacgctcgctgtaaatggtttaaagcgcatttacctgagcgtccccgttgataattgaccaaaaacatgatacagttttctgcgttttgtttcacctgattgagggaacaggaagaaaggaatgatctgcaatcgtgcgaccatactaaaaaatggcgtattgaaaaaaatagtcagagggtgagaacgtttgaagaagaacatctccagtgttttttggattgtgattgtcatcacagcagctgcggttttatgggggccatttctcctgacagcctgcagcaagtcactgatacggcacaaaaatttattacggattctttcggctggtattatctgctggtcgtttctatatttgtcggtttctgtctctttctcattgtgagtccgatcggcacaataaaactcggaaaacccggggaaaaaccggaattcggcttattatcatggtttgccatgcttttcagcgcgggcatgggaatcggtttggtattttacggggctgcggaaccgatcagccattacgccatcagctctccctcaggtgaaacagaaacaccccaagcatttcgtgatgcgctccggtacacgtttttccactggggactgcacgcttgggccatctatgcggtcgtcgctttatgtatcgcttattttcaattcagaaaagacgcgcccggtttgatcagcagcactctgacaccgcttttgggcgataaagtaaacggcccgatcggcaaagcaattgactgtatcgcggtgtttgcgaccgttgtcggtgtggcgacaagcttagggctcggagcgactcagatcaacggcggtctgcattatttattcggcattccgaaaacattttccattcagctgatcctgatcgctgtcgtgaccgtgttatttttgatttctgcgtggagcggaatcggcaaagggattaaatacttaagcaataccaacatggcgctcgcgggtattttaatgatctttatgctcattgcaggcccgacagtgctgattatgaactcatttaccgattctatcggccaatacatccaaaatatcgtgcagatgagctttcgcttgtctccgaatgatccccaaaaacgcgaatggattaacagctggaccattttctattgggcctggtggatatcctggtcgccgtttgtcggcatttttatcgcccgtgtatcaaggggccggacgatccgggaatttttaatcggggtgttggtgacaccttgtatattggctttcttatggtttgcgattttcggtgtatccgcgatggatcttcagcagaaaggcgtattcaatgtcgcgggaatgtcaacggatacgatgctgttcggcgcactcagccactatccgctgacaatggtgacatccgtattaacgcttattctgattgctgtattctttattacatcagcggattcagcgacatttgtgcttggaatgcaaacgtcttacggctctttggacccgtcaaaccgggtgaaaatcatctggggcgtcatccagtccgccgtggcagctgtattattatattccggcggtctggccgcactgcaaaacacggccattctcgccgcggttccgttttcagtcgtgatccttctgatgatcgtgtctctgtacaagtcattagcgagcgaaagaaaaggaatcaaacaagcggagaaataccaaaaaccgagaagtccccgcgtcaaaaaagcataatgcataaaaaagcccggtatttcatccgggcttttttattttcggtataaaatgagagcggaaaaacaataaagctgctcaccttcaggatcacaggccgccgctaccgtatatttaatatcaacgagctgttcatcagaaatcccctttaaaaatgtattgacttcagtctgcagatccttttcatgctcctcatcaaaaacagctatcttcagcacatcaccctctcctttctctatcaatttattccggttcaattgaaatatgatagagaaaaacagattttcttttttactgatttttactaaaagtaaccaaaaatagttattgaaaacgcttactaatatatgataatatcattttaacaataaccaggtcatttctgtttagtaaatatttagtaaaaaggagatacgaaatggtccgtctcaaagatattgccttacaggcatctgtatccagcgcgacagtatcgagaattttgaataaggatgactctttggccgtgactgatgaaacaagagaaaaagttctgaggatcgccgatgagctgggctatcagccgtcggcaaaaaaacggaagaaccgcagccgcagcgattcagcccccctgatcggcgttgtcagctgcctgtcaccggaagaagaacggcaggatccttatttttcagcgatccgaaaaggcattgaggaagaatgctttcggcaaaaagtttttatcacatcttctatccatctcgggtcttttcaagagcatatgtttcacgatctggacggcgtgatcgtaatcggcagcctgcaagacgaggcgcttacgaatatcagcgccgctttcaggcacgcggtatttgttaacggcacccccgatcccgcccgctacgattctgtcagcgtggatttttatgccgcagcgcaaaaggcgatcgaacatcttctgtcgctcggttaccagcggctcggttatatcggcggccgggaacgggagcataccgtcatagacggtgtaaacagcaataaaacgattgaggataagcgtctgaccgctttcttacaaatggccggagccgggccggagcatgtactgatcggcgaatacagcatgcacgaagggttccggctgatgaatgaagccatcaaaggcggaagtctccccgatgccttttttatcgcaagtgattcgatggctgtcggcgctttaaaagccttgcaggaagccggccttcaagtcccgcgcgatacggcaattgtcagcttcaacggaattgatgaggcagaatacgccagcacgccgttatcaacggtaaaagtatacacggaagagatgggccggacgggtgtcaaattgcttctcgaccgtttaaacggcagaaccgtcccgctggccgtgacgctccccacttcattgattgtcagacaaagctgcggctcacaagaaaggaggtgacatgtcccgcagcgtttatatcatatttaaaggaggaaaagatgaaacgcttactggctttgtttctttcttttacttgcatgatactacccggctgctcggcagaacagagcggcgccggagaaaagcagaaaacattgacagtctattccacaatatcctcagacagcgaacgcgccgtattcagaaagttggctgattcattccaaaaagaacatccggacattcaagtaaacgttcatttcccaggcaatgactacgaaaatatgatgagggtcagaatggcagccggtgacatgcccgatcttttcgacacacacggctgggctaaaatccgctacggagaatataccgccgacctcagcggcatgtcttggacgaagcggctcgatccgaatttaaacagcatgctcaaagacgccaaaggcagaatatacgccttccctctgaatcaggcaaaggacggactggcctacaaccgcacaatgttggaaaaatacagaatcaaaccgccggaaacaatggatgattttatgaaggcactgagacagattaaagaaaaaagcggcggaacagtcacccccttctggtttgccggctatgagaaaagctcatttgcccaatattacgatcaattcgccgcaccgcttctcatcacagatcccgcacaccgttacaaaaaacagctgttaaacggaaccttccgctggacacacttcacctatttatctgacaaactgaaagagatgcaaaaggaaagcctgctcaatatagatgccgtgacggcaaaacggtcccagctcattgaactgatggcgcaaaacaaaatcgcctttacgctgcagggcggcaccctcggccaagacgtcgctcaaatcaatccgaaggtaaaagtcggcatcataccgaccccggccgtccacaagggagacgcgccggtttggatcggaggcgaacgttacacgctggcggcattcaaggattccccgcggcttgaagaagcgaaacagttcatcgcatttatggcccgtcccgagcatgcgaaatcaattgccgaagcgacctcgcttccggccggattagtgaatgtgcaaacggacattttctacgcaaatgactataagcgctatcagcatattaaggtgcagccttattttgaccgcctttatttgccgaacggaatgtgggatgtgatggggacagccgggcaggagctgacggccgatatcttaacccccgcggaagtttcggcgaaactcggcagggaatataagcggctccgtcttcaatctgattcacaaggagctgacaaagaatgagtgatcttgcaagagaaacccaaggatttcagcatcaaaagccggtaaaacccgcgtcactgtggtggatgtacgttcccgctcttgccacggtttttattttcatgatttttccgtttgtcaaaggcgcttttatcacattcacaaactggaacggcttctcacagacgtatcaatgggtgggggtcactcaatataaaaggctttttacagatccggacacgtggcttattgtgaaaaacactttgctttacggcatcggaagcactttttttcagaatatgctcggacttttatatgcgctgcttttgaatcagagcttaaaaatgaaggcgctcacaagaacgatcgtctacctgcccgtcattatcagtccgctgattatgggatacatttggtattttattttctcatatgacgggggtgcgctgaatgatgtactgggcgcactgggaatcggtcctgtcaacgccttggcaagccctgcggcaaacccgtggattatcgtcatgattaacacgtatcaatacgcaggcattgcgatgattgtatatttggcggggctgcaaagcattccgaaagattattatgaagctgcaaaaatggatggcgcgggaggtcttcagccgtttttcaccatcaccctgccattattgatgccggctgtcaccatcaacatggtcatcaatatcatcggcgggctgaagctgtttgatgtcattttcgctctgaccgcaggcgggccgggcaattcctctcaatcgatgtcgacgtttatgtatgatttatattttaaacggcaggatgcgggatatgccgccgcccaaggcgtgtttatgtccgttattattcttgtcatcagcttttcggctctcgtgtatttcaagcgaaaggagacggaaatgtcatgaaaacagcccgaatgcggatttttacgctgttggctgccgttatctcgtgcgttcattttgtccccttttatattttgctgaccacgtcattaaaagcaaaaggagactacagttcaaaatggtcgctgccatccgccttttcatttcagaattttcgtgaagcatgggagcgtgcctctctcgggcaatcctttctgaacacgatcattattacagccgtttccgccgccttgctaattttcatgggttcgcttgccgcatacccgctcgctagaagaaatacaaagctgaacaaaatcgtcttcggccttttgatttccatcatgattatcccgcctttgacttccatggttcctttatacaagatggtcgctgatgcggggctggtcaatacgcatgccgcagccattctcattaatacggctgcatatatgccgctgaccgttttcttatattcagggtttatccgctcttccattccgaaagaacttgaggaagccgccaggatggacggcgcgggattgatcaggactttttatacaatcgtgtttcctttgttgaaaccgattaccgcaacggtctgcattatttcctgcgtgtttatctggaacgattaccaatttgcgattttctttttacaagatcaaaaggtgcagacattgaccgtggccatggcggggttcttcggcgaaaacgcgaacaatcttcacttagtcgccgcagccgcaattatggcgatgctgccgatggtcgtattgtttttggcacttcaaaaatattttatctcagggctgtcctccggggcggtcaaaggctgagaagaaaagggaggaatttctgttgaagaaaattacgtttatcggagcggggagcacgattttcgcaaaaaatgtactgggggactgtttactgactgaagcattaaacggatttgaattcgcgctttatgatattgacgctgtacggctgaaagaatctcagctcatgctggaaaacatgagagaccgctacaatccgagtatatccatcatctcctacgatgaccgaaaacaagcgcttacacacgccggctatgtgataaacgccattcaggtcggaggctataaacccgcgacggtcattgactttgacatcccgaagcggtacggtctccgccagacgattgccgataccgtcggaataggcggcattttccgttcccttcgcaccatccccgttttatttgacatcgcaaaagacatggaagaggtctgcccggatgcgtggctgttaaactatacaaatccgatggcctctctgaccggagcgatgctcagacatacaaatgtcaaaacggtcggcctgtgccacagcgtccaggtctgtaccaaagatctgttcgactcactcggcatggatcacgaaggtacggaagaacgcattgccggcatcaaccatatggcttggcttttggagattaaaaaagacggaattgatttatatccggaaattaaaagacgggcacgcgaaaaacaaaagacgaaacataaggacatggtgcggtttgagctgatggataaattcggctgctacgtgacggaatcatctgagcataatgccgaatatcacccgtattttataaaaagccggtatccggagctgatagatgaactccaaattccgcttgatgaatatccgaggagatgcgcggaacaaatcaaaaactgggaaacgatgagagacgggatcatcaacaaccaaaacctgacgcatgaacgctcgaaagaatacggttcgagaattatagaagcgatggagacgggccgtccgttcacattcggcggcaatgtgctgaataccgggctgataccgaatctgccggcgaaagcggtcgttgaagtgccgtgcgccgccgttaaaaaccaaattatgccgtgctattccggcgaacttccggagcagctcgcggcgctcaacagaacaaacatcaacacacagcttttaaccatcgaagcggccgttacattaaaaaaggaagccgtatatcaagcggccatgcttgatccgcatacgagcgccgagctttccatgaatgacatcatctctttgtgcgatgacttatttgaagcgcacaaagaccggcttccggcttatcactgatcattcgcgatccggtcccgggcgggccggacgtttttatatgttcagcaccagtttgaccgtctgtaaggtgtgtcctttaaaatcttcttcaaattcacataccctttgaaaccctttcgcttgataaaaggacaaggcgatgcggttctctttttctgcatggacataaagcttttttaccccgccggactgcctgatgcattctttaagaagtgccgtgcctatcccgcttccctggcaatccggatcaatatagatggcggtcagctccgcatttccgtctttttgaaccggggtggcatttgcaaaaccgagcactcgcccctcttcttccgccacaaagaacaaagaatgcaagagccggcgttccatcatctcatcctgataggcggattcgagaaactgatcctgaatgtgtctgggaataatcccttcatacgtatgatgccagctgcgttctgcgacttgccggacctgtttgatatcgtttgttttcatcgcgcggatcatcggtttcacctgattcgcctcccgttttttttataaaaaaagaagaaaaagacgcacgtcccttttcttctttcacttcaaagcgttatttcttcggctttgtttcgccttcccactccagcatgccgccttcaacattaactgtacggaagccctgctcatgtaaatacatacaaacgttcatgcttctttttccggaacggcagataaatacatattccttgtccttgtctaacgcatccatcttctcagggatgtcccccatgcggatatgaacggcctccggaatcattccttcggcaacttcttcgtcttctctgacatcaatcagatacagctcttctcccgcttttaatttttcttccagtgcggctgtgctgatttcatttattttcaatgtgtgacactcccattcatctttatggtgttaagtataccaaagcccgcggtgcaatttctatgatagaggcctgataaaaaagcccctctctgtaggagaggggcttcgtccggtcagtttgccacgatattgacaagcttgcccggtacggcaataatttttcggatcgtttttccttcaagctgctcttttactttttcgtcagcttgtgcgagctgttctaacgctgctttatcagcatcagccggaaccattaatttcgcttttacttttccgttcagctggacgacgatttccacttcatcgtccaccagttttgattcgtcataagcaggccaagcctcgtatgcaatcgaaccttcgtggccgagtttttcccacagttcttccgccaaatgcggcgcaacaggagaaagcagcttcacaaaaccttcgatatattctctcggcagttcattcgctttgtaagcttcattaatgaacaccatcagctgagaaatgcccgtgttaaaacgaagggcttcgaagttttctgtcactttcatgaccgtttcatgatagacgcgctcaagagtttcgcccgcgccttctgtcactttgcccgtcagctcgccgttttcctcgataaacaaacgccatacgcggtcaaggaagcggcgtgctccgtcaaggcctgattcagaccaggcgatagatgcgtcaagcggccccataaacatttcgtacaggcgaagcgtatctgctccgtgagacgccacaatttcatccggattgacgacgtttccgcgggatttactcattttttcattgttttccccgagaatcatcccttggttatacagcttttggaacggttctttcgtcggcacgacaccgatatcatagaggaatttatgccagaaacgagcgtacagaaggtgaagcacggcatgctccgcccctccgatgtaaatatcaacgggcagccatttatccagtttctcaggtgaagcgagctgatccggatttttcgggtcgataaagcggaggaaataccagcagcttcccgcccattgcggcatcgtgttcgtttctcttctgccttttctacccgtttcaggatcagtgacttccacccactctttaatgttggcaagcggtgattcacctgttccgctcggtttgatctcatcggttttcggcagaatcagcggcagctcttccgccggaacggctgttgacgtaccgtcttcccaatgaatgaccggaatcggctcgccccaatagcgctggcggctgaacagccagtcacgcagacggtatgtcactttcttctcaccgtttttcgtttcttcaagccaggcgatcattttttcaatcgcttccgctttattcagtccgttcagaaagccggaattgacatgttctccgtctcccgtgtacgcttcttcttccgtgtttccgccttttacgacttctttgacaggcaggctgaacactttggcgaattcaaaatcacgttcgtcatgcgccggcacggccattacagcgcccgttccgtaagaggcgaggacataatccgctatccagatcggcagcttttccccgtttgcagggtttacggcatatgcacctgtgaagacgcccgtttttgttttcgcaagatccgtccgttccaggtcacttttcgcctgaacttctttaacataagcgtctaccgcttctttttgttcaggcgtcgtgatggcctccacaagctcatgctcaggagccagtacggcataagccgcgccgaacagcgtgtccggtcttgtcgtaaacaccgtaaacgtgtcatcagtgccgtcgatcgcgaaatgcacgtttgcgccttctgagcgtccgatccagttgcgttgcatgtctttaatgctttccggccagtcaagttcttctaaatcttcaagaagcctgtccgcataagcggtgattttcagcatccattgtctcatcgggcggcgttcaaccggatggccgccccgctcgcttttgccgtcaatgacttcttcgttcgcaagcaccgttccgagcgccgggcaccagttgaccggcacttcgtctacgtatgcgagccctttttcgtacagcttggtgaagatccactgcgtccacttgtaatagtccggatcagtcgtattgatttcacgatcccaatcataagaaaatccgagtgattggatctggcggcggaaattatctatattttgttttgtgaactcagccggatcatttcccgtgtcaagcgcgtattgctcggcaggaagcccgaacgcgtcccatcccatcggatgaagcacattgtacccttgcatgcgtctcatgcgagaaaggatatcggttgccgtatagccttccggatgtccgacatgaaggccggctcctgaaggatacggaaacatgtcaagcgcgtaaaacttcggcttgtcattctcttcactgacggcgaacgttttatgatccaaccagtaattctgccatttcttttctattttttcgtgctgaaaactcaacgtaaaaacctccttctgattgaatacggcgtatgtagtccaagtattgacgggatgaggaagattatattcagattattctaaaactaaaaaaaactccctcatccctaaaagggacgagagatttttgtttcccgcggtaccaccctcgttagcgcggttttaagccgcactcacttgatacttttaacgcagttatgcgtcagcggttttgccgctgcaactctgaggcgagttcggaaacagacttgattgacttgcaccggccgtcaattctctgagtgcgaaatctgcttcttactgctcctcttcactgttcttatcgctaccgtaatcttacctgtattttatagaattctgttcataagtgcaagcaggtttgtatacaatgggaatgtacccggaacgggtcgtgagcggggatattattttgatggaggatttttttgctggtgtggttttgcttcggccgaatcactgttttgttctctgacaaaatcaaagctcctgagaacagcttctccgccgtagcctgcgattatggataagatgacgagttgaattcctgaatcggggtcagcggataagacaagtaagatggaagcagccattccgataaaaccatcttccaaaaaaccgagatagataaaccgctttgtcattctgggtttctccagcctgcctctctttttcacatgaccgagaacccccatgatgcctccaattacacaagcaattattacctgatgcagcatcttcatcaccttcctaaagcccttatttagtaaagcgacttcaggccatccagcccccttacgaatacgatgattttcgatatctacataccggcgattgagcaggaaagtaaaaagcttgtttcttccattatatgtgaacacatgatcggtaagcttgatgcattagattcatttttcacccagtgacaatgacctagtcacttacttagcgatgatgtgccttccccttatatattcagtgtatatgaggacaagcccgaatgacaaattgcaaacttcggctgcttgaatcagaacatatgttatgctacggttactgtagattcatttaaaaaggggagaaacaacggctgaaaaaagcgcgcagctttacggccaaaagggggttttacatggctgactcaaatgtatccggaaaactggagcagctggagcttatcaaaaaggcgcttgatcacgcacgcatcggcgtggtgattacagacccctctcttgaggacaatcccatcatatatacaaatcagggatttatggatatgacaggctacgcttccgaagagatattaggtaagaactgcagatttctgcaaagcaaagaaaccgaccgtcaacaagtcgcgaaaataagaaagagcttaaaccagaaagaaaagatcacggtgcggctgaaaaatgtcaaaaaagacggcaccccgttttggaatgaactcaacattgatcctctgtatgttgaagacaagctctattttgtcggttttcaaaaagacattacagagcagaaagaatacgaaaagctcctggaggattccctcacagaaatcacgacgctgtcaacaccgattgttccgatccgaaacggcatctccgccttgccgttagtgggaaacttaacggaagaacgatttgattcaattgtgacaactttgacggacatattaaccgcatctaaagatgattacttaattatagacttatcaggtttggccgaggtaaacgaacagacggcagaccagattttcaaattgcaccacctgcttaaattaatcggcacagaactgattatcaccgggatcaagccttccctcgccatgagaatgaatcagcttgatgccagcttttcttcattaaagacgtatttaaacgttaaggacgccgtcaacgtgcttccggtcgtataaacaaaaaaatcccgctgtttcggcgggattttttatgtcgtcatcgcacttggatgttttgtttattaacggttttcaggcgtttgtcgtacagcaccgtcgctgcgatgctgacaacaagaagcaccatcaggatcaacagcagcacgctcatgccgtactgatcaaccagcacgccgccaaggagcggcccgatcattctgccgcccgtcgccgcactgttgacgaatccttggtaaaacccttctttccccttaggcgcaagctgattggcaatggtaggaacggcaggccagacaagcatttctccgacggttaaaatcaccattgcggtgaggtacatcggaaattgcttggcgctaagaagcacgccgaacgaaacgataaaaatacaaaagccgatgaccatctgcgtttttaacgcgcctgaccattttttcagaacagctcctatgagaggctgtccggcgacaattaatattccgtttacggtccagagcacactgtataatgaaagcggcataccgatgctttgagtatgtgacgcaacggttgtggaccactgcgaataggcaatccacccgagaacatacccgccgctcaatatgagaagcgccgtaaatttcgttctgctgctgacaggctcgtagtccagaacagaaacctggctcgcatttccggttttgatatttcgaaacccgaaaaatacgataaggaaaaacagcacatacagcaaagcattggctaaaaacacgtacgtaaacgagtacgccgcaaccatcccgccgagtgccgagcccacggcgacacctgcgttctgagctacataaatcgcattaaaagctctccgcccgccttctttccataccgctcccgccatggcgtaactggccggaaacacgataccggaaccgaagccgacaatgatgagcagccaaatataaacgggccattggtgaaacagaacgagtccgagaagacttgccaatgtgatcataatgcccagcataatggatttgaatccgccgattttatcaaacaaaaatccgccgcataaattccccgccacactggccccggaattcagcatcagaacaatccccgcaacagtcagcgatttccctaaatgattatgaatatagatcgtattcagcggccacaaaaaagatgcgcccgtcacattgataaacattccgatgattaatatcttcaaagcgcgcggcataccgatccccctctctctataaaaaaccccatgaaaaaacggaaaccgcaagccgcggctccgtatcgatcacgttatcatagcacattcattctatcgccgcggacgtcttttttcaacatcagaatctgaaaaaaataatgccggaatgttgaaaaaattacaaatgattggattcgcaaaaacagcccggcttcatgctcttttcctcagcagccaaaacggaatatacagaatgaagaagctcaatatcaccgccgcttccattgatagaagataccacggccaaggtccgaaaacattcagaagcgaagcggtcttcggttttttcattaaatatagataatttgcattcagcacacgatcaataaaaaagacacacgccccgtacagatttacgatcagcaccgacacccacagcccgcgcgccgacggcctgtacctttctgaagcggccatgaatagacaggtaagaaaaacacagccgtgggagacgaaaaacacgatgtaccgaaaatgcgggaaagaatacgcccctaaatcaggtgttgccatcgcctgtacggcgctgcccaaaccggcaaaatagaggaaggcgaatagctttttgctttttgtcatgaccatcagcatcgccaaatagacggaaaggtcgctcagctgcagcggcagagctgttttcagcgaccaggcatgatgacaaagcagccatatatgatagctgatctgcgacacggcaaggagaatgaatagtacatagcggatcatgcggctctggttgagctttttccggaatacgatcacgcccgcccccagcaacccgatgatcaacaatgtgaaaatgtgttccttggaaaaaagatgaaaggcccctgtttcagatttcaattgaaaatacttctgcataaggctcccccgcgcgaaaaaatgacgtatgtctattcttttaaaaatcgctttcttctattcatacaaaaaaagcctccgcttatgcggaggctcctcaacttgttttacaaggcggattgaatgacctttttataatacagcaccgacagcatgccgaagatggagtacagcagcgtatacagcgccatgacgatgatcatcggcgtccacacttccgttccgaataaaaaccatcctgactgaacggcaaaatagctgtggaacagcccgagaacgagcggaatgccgaaatgatacgcctgcttccggcggatgcctttcagcagatctcccgttgtgaagccgagcttccgcaatatcgtataatcagccttctcatcctcacactcgcccatttgtttaaaataaaggatacagcctgaggtgatcagaaaggttaatcctaaaaacccgacaataaacatgatcagccccatgtttttcttttgcgtgtcagccgtttcaaattgtgaaagcgcaccgtctgaatagtgctgcgcctgaaacagaccatcagctttttggatgtcctcttctcgtttgagtgtaatgccgaaaaaccgatttgattttccctggatggacgggtcgatatctttctcgatccggtcgaatacctgctgcgtgacgataacggtcggcagccctccgcttgtaaatgtatatgacaggaggaagtcgttcttcaagcccttatacgccagcggtattttatccgttttgccgtttatatcaatggaacccgacgttttcaggtcgagaaatcttttcatcatatcattatatccggtaaacacggcttctccgtcagaaagctccgtcccttctgcgtctttctcgcttataatcggcagcgccaggctggacgggtcttgttgaaagcttttcatgtcgccgtttataatgttcttcatattgacaccggcttgaatggtcttgattgtttttactttgtgttcaattccgtttttcttcaataaagcggtaaaagagtcagtctccttttggttatcaaacgcaaagtccgcggctgtattttgctcagccgatttttccgcggagtagtacgagatatagcttaaagacagcaaaccgattgccagcgccgaaagagtcgtaataatcgtcagcaatacggcgtttgacttcatccggaacatgatggatgacaaagacagcacttcactgacattcagatacccgccttttgatttccggatgagatttgccagaaagctgaccgaacctttataaaacagataggttccgataatgaccgagccgagaataaacaccatggccgaaaacagttcattcatgctcgtaaaactgcctccgaataaatccgcggacacggcatagccggcgataatggccgcaataccgacaacgccgatcaacatctgcacccaagaaagccgtcttatgccgctttctgacgatgacgcggttttaaataaagacaaaatgctttgccgtttaataaataagtaattcatcatcataatcagcacgtaaattgccccgaacacaattaacgtctgaacgagcgccttgcttgaaaaaaacagtgagacagaggctttcacaccgactgtatgaaacagcatcatcatacataatttcgagagggaaaagccggcgaaaataccgatccaaatcgatccgaaatacaaaatgaaattttctgcgctgagtatgcggaaaatgtgcattttcgtcatcccgattaatcggaataagccgatttcccggccgcgccgtttaataaaaatggtgttggcatataaaagaaataccgacacgatcgccacaagcagtacagaggcggcccggattgccgccgctccttttatggagcttttcatttcatcaagcgccggatcgtattgcatcgtgacaaacgcgaaataaagggcggcgctgaacaccagcgcaaaaacgtaaagataatagtttttcatattctttttcaggttctggaagatcaaatgatgaatactcatgcctgaaccccgcccaatacactttgcgttttcataatatcctgaaaaaagtccggtctgtcctgaccgcctttattcagctgcgtatacacacggccgtctttaatgaaaaccacacgtccggaatagctggcggcaaccggatcatgcgtcaccatcacaatggtggcgcggcgtttttgattcaggcggctgagtttattcaataaatccgtggcagcctttgaatcgagcgctccggtcggctcatcagcaaaaataatgcccggctcgtgaataacagctcttgcggcagacgtccgctgtttttgtccgccggaaatttcactcggatacttatgtctcaaatcatagatcccaagctcctctgccgtctcggcaaatcgcaggtccgcctctttcttagacattttcgtaatggataacggcaggagtatgttttccttcacggtcagcgtgtccaataaattataatcctgaaaaataaagccgagatgccgttttctgaattcggcaagctgtttttctttcatggatgtaatctccgtctcgttcagtttaatggtgcccgagctcactttatcaatggaggaaagcacattcaaaagggtcgttttccctgatcctgacgggcccataatgctgacgaattcccctttgtgaatctgaagatcaattcctttcagcacctcttgtttattcagcttgtttccgtagcttttttggatattgcctgcttctaaaatcatcacgttatgattctccttttacattggttatctttattttaaaaacagaagccgtttttttcgtttgattaagcgaacaaaagagaaaagcatgtgacacttttgtcacacgctgaacatgctgacggcatcgttctgttttggaaacaccaaggtaaaaatcgtgccgctttccggctcagagcgcacgctgatctggatgagaagcggagccgcggcttttcgagccaaatacaggcccatccccgttgacgcgtgatctcgcctcattcgcgtcgaggtaaatcctttttcaaaaatgcgcggaagatctttgggctcgatgccgatgccgcggtcttcgatatcgacatgcacccggccgttttgttcatagctttttacggtaatgtcatccgcttcactgtatttgacggcattgcttaacagctgcctgatgatgaaggaaagccattttccgtcactgtgaacgtccggtgaatcaagctgaatgtcaaacccgatccctttttgtatgcaccatgattgcaggtttttaatttctttgaaaacgagcggtctgagctgaatgcgctggaatgataaatcattttcaataaaggacaatcgtttctgatgaagctgctggtccaggagatggtgaatccgcagccattcatacagcaaaggggctttcagcggctgttcatcaaggcgctcgatcatgagatgcatcgctgtcagcggtgttttgacctcgtgaatccatgacatcagatcatccttttcatgctctgacgccgcctgaagatcaagtgagctttttcgtaattgctctgtctgcccttcaatgctttcttcaacgatagactcaaacggactgtcaggcgctttaagataagacatgtctaaattggcgtcccactctcttaagcttttataataggcggtctctttacgatagcggaacaagagaaatacaagaaacacaagaagcgacaggtaaacaaaatacagcaccgaaaaaaacggaatagacgcatcaatatatgccgcaaaaaggagcacagcctgctgcaaaagaaacatcgcgatccagctttttctttcgagcagaaatgatttaatcataaagaccgtcttcttcctttgcgatgtatccctgccccaccttggtttcaatcattttcccgatgcctaattgatcgagttttttccgcagccggttgacattcaccgtcagcgtattatcactgacgaaacgctcatcattccataggcttctgatgagttcttcccggctgacgattttatttttctgctcagccagcagttttaagatcagcatttcgtttttggtcagttcgaccgaaccgtttttacagctgaccgtgttggtttctgtgtcaatgaccgccccgcaccatcttttcatcagcgccggttctgtgccgtattggtgcacacggcggaacaccgcctgtattttcgcgattaacacatcaaagtgaaaaggcttctgaataaaatcatctgccccgagctgcatcgacatgaccatatccgcgggatgatcgcgcgaggacaaaaagagaatcggcacgtttgattgggagcgtatcattctgcaccaatgaaagccgtcaaatttcggcagctgtacatcaatgatcaccaaatcaggcttaatttcagtaaactcccggatgacccggctgaaatcctttattccgtgcaccgcaaatgaccagcccgttaatctctccttcatctcgtgaaacaaagtgttatcatcttctattaacaaaatgtgaaacatggtatccgcccttttctgatagatagaggaaaaaccggctgatgtccagccggcttttttcctttacagttctcttcttaatgcggtcagaacgttggtttttgtcgctttgcgggccggattcataccggaaatcaccgcgacccccgcacaaatgacaactgcgatcacaacgaggctgagcgggatgtaggagaaggtataatgaagatcttcagctccggtatttccccctaccgctttcaaaataaccggcacagccagattgacggcaaaactcactccgtaagaaatgataatcccgatgacagaacctaatatcccgatataggcgctttccatcaggaacattctgcggatgatggacgggcttgcgccgatcgctttcataatcccgatttcctgcgttcgttccgtcaccgccatcgtcatcgtattgaaaataccgatggctgaaatcacgacggcgataaagccgacaaagatcagaccgattttaaagacgaggaaaaaggtgttgacgcccttcagctcggttgtgacagatctgacataaaagccgtcatccgtgaggtcatgggtaagctgatcgacatgatcgaatttgtccgcatacacattgatgcttttttccgcatttccattcttcagatccaagaatgtcgagaagtctttcttgaattgatcactcacaaaaatatttgtatcctccatccaatcttgggacggtttttttgtaattccgactactttgaagtcgtacgttttcgttttttcaacgtctccgtctttgtttgttttggagatgctcagctgtatcgttttattaagcaggtctttcgtatagccttttggttttttcacctccgacatgtcgccttggtgatcctttaactctttgtcgtaagcgtcagcctcttttttcgtcaataggttcttcgcaaaatcatagccgaccacgatttcattctctgtacgggcgactcttccctgatcaagctccatattggctttgacttcatctttcatgtttgtcagcacaatggctgaatcttcatttgttcggtttcccaatgacgctttgttcggttcatacacttgtgttctctcaacgacagacttgacatttttatacttttccaagtctgatttcttcacggcttttccgttctcttggccgagcacattgatttccgtaacaatctgctggctcatcgtaatgtctgtaatcgttttttggatgccgaatccgacggaagccagcaccactaaaaacgcgcacgccattgtcgtcgccagcaccgtcatgaaaacacgcagccggtttttcttcatatttcttctgataaagtgaatctgatccttaaatctcaacagtaacgcccccttttaatacaccgtcatgcagctggaattttgaatgcgcgatcgaagcgacttcatcgtcatgcgtaatgatgacaaatgtaatcccgcgctcccggttcagctgctgaattaatgcaagcacctcaagttccgtttctgaatcgaggcttcccgtcggctcatcggctaaaataattgacggatttaaaatgagggctcttgcgatactgacacgctgctgctggccgcctgacagctcattcggataatgattcgcatgattttcaagtccgacccgtttcagcatatccgcgactttctgcttgcgttcagacggtttgacaccttttaaggcaagcggcatttcaacattttcataggttgtcagactcgggatgagctgaaagctttgaaaaataaagccgaaatgcccgaggcggaactgcgcccactctttttcattgaaacccgtcacatcagtgccgttaatgacgatacggccctttgtcggcgctatgtatcccgaaattaaattcagaagcgttgattttccggaaccgctccgcccgacgatacaggcaatttcccctttttcaacggtcaaagagacatccttcagtaccggaacctcactctctctgcctttcctgccgattttaaatgaatgatcgatatgctgtacctctatcacgtacaccactcccccttatatctgtttcgtttttttatagatgaagtaataactgatgaaaaacccgataatcgcaccgatgagcatgccgaatatgtaaccggtatacgaaccgttataagcatatccgcatacccccgcacttcccagcatactgagcgacatgacgagcacttgaatgatgcgttcaatgtgtttgctcaggataaaatgtccgcttcgttcattcggcattttcaggaaattcacatagccgaatagatagaaacaaaatcccattaatgcggagatgaacaatgcgtgtttcatgtaatacatccatgatgtatggatgtaagcggcaggcatgaaatagatcagaaatccgctccaagggaaatcaatatccggcacagcctgcctgccaaaaaggaactcggcgtttaacagataaatcgtcataaccacgatcggaaagacggaaaccgtgaacgctgtgatcagctgcgccgctaaattgcccgttatcgtgccggcagctgtcactaatgcgtaaatcatcaagctgatgaccagcatccctgcgctgaatgattgaaaatgatggacagcgtcaggtttaagcgctaggaacaatatgtcggatactccgtaagaaacaaactgcgagccggctaacacggctgctcccaagaaaaacttcgtatgaaatatccggcttctcgaatacggaagactcagtgtaaacatcctttcagcccggcctgctcttatcagaaaaagccccataacaaccggcggaatgaaatgaagcccaatcaaattccgataattgctgtaatcgatgctgaatgtacaaactgaccccgggtacagctgaagtgcacgtaaacaatccttatagtgaaaatactcatttataattgccaaagggcctaagatagataagaaccccgctgtaagcagcagcagcgtctgccgctgcttacattctttataaagcaaaccgctaatcggcaccttgccttcctccaaactgctcattttcaaacggatctacatatgctttgactgtctgtaaaccgtaaaataactgatgaaaaacccgataaccgcgccgaagataatgccggctaaatagccgaacatcgtgtctgtgaccccatatccgaaaacgccgaaacccataacggcaaacgcaatcaccaagatctgcaccggccggtccaattttctccaaagaaagaatctgccgttccgttcattcggatgtttcagaaagctgacgtaaccgatcagataaaagacaaggctcatcacaatcggaatgattaaaatcaaatctctttctctgatccagtcgttaaacacatatccaataggggttataaatataaaaagacgggattcgatataactgctgataaaagaaaattgatctccgacactaaaatcgaaaacgacctccaaattcgcggccggcagaccgatgagtaaaaagggcagaaccgttactgtaaacgccgttaacagctgggcgaatatatgtcccgttattgctccggatgccattaacaaggcgtaagccataaagctgatgacaatcattccgattgaaaaatgatcaaaatcgtacgtatggctcggtttcaacaaagatatcagcaatgacgccgctccatagcctatcgcctgaggagcaacaatgactgccccgccgagccagaatttcgtctgaaagatttggcctctgctgtaaggcatgcttaacaaagcatccatcgttccctttgtccgttccaagcctaataagaagacagcaatgatgacactcacaacccagctgaaggaaagaggcgacccattcgtataattgacaacgaattcacaatcttgaagagctgggttattcaaacattcttgatatgttgagtagttgttataaaccataaaagggtttgccgccattaaaagaatgccgctgcataaaaacaaccactgattttttttccattctgtgtacaacaatccccgcggtatcattccggtcctcctctcttacacatgcttcgtttttttataaatcacaaaataactgaccaaaaatccgatcgctcctccgaccagcatcccggccacataccctgtcatcgtatgtcccgtcgagtaccccgccaggccaaaaccgagaacggcgatgatgatcaccacaatctgaatgggccggtcaagctgtctccaaagaaaaaaacggccgttccgttccaccggctgcctgacatagcaaaagtacccgatggcataaaatacaatgctcatcactgccggaatgattaatatatacttgctggcagatacccagtccgtattaacatacatgatcggaatcagatattgaaacgaatcgtttaggtaagcattgactgatggcatcagctcatgcatgccgaccctgaagataacttccgcatttgtcagcggcaacgtaataatcaggtaaggcgctatcgacacggcaaacgccgttaacagctgggcgaacgtattccccgttaagcagcctgcgctcgcgaccaatgtaaaagccaaaacactcacaataatctctccgacgctgtaatggtggaagaaatatacgcgctcaggctttaacagaagaatgagcagctcagccagcccgtagccgatcacctgagcgccggtaatgaccgccgctccgagccaaaatttagtgtgaaacacctgagcgcgggaataaggcagactgaaaagcgcatcaatcgttcctttcgtacgttccagtccgaataagcaaaccgccaaaatcacagcgggcgcccagtttaagttcagcattccgctatccaaagaattcacataaaacttacaatatgcttcgtgggtgtccagacagccttgataaaccagataggtatttaacacttcaaatggattgaccgccgctaaaaaaatgccgaccatcacaagaacagttcgattctgcacccattccctgtacagcaatcccctgtctaccatctccggtcccctccaaacttcgcgatgaaaacttcttctaagttcacaggaagttcgttccatactttcggctgcagctcttgcagaaagttctttttcttctcatcgttcttttgaatcagcaccgtataaaacacaccggcatggtcgagaatcggtatattttgttctctgatcttcaaggcgacgtcctcttcaaatgccatttggattttcatgtactcttccttcatatcatccaagtccatcacattcgtcagctgatttccttccaaaaacccgatccggttgcacattcgctcaatatcttctaaacggtgtgaggtaatcagaatgctcgtttcccgttcagctacttcatccaccataagctgcagcacgtcatgacgcgttacggcgtcaattccgtccgtcggttcatccaaaaggataagagccgggcgtgaagcaaaggcaaggacgagcgcaagctgttttttcaggcctgtggataattcacggtatttcttcgtttccggaatgccgtacctgttcatcagctcattggcgtaagtcacatcaaaattcggatagattctgcttacaatcgcaacaagctgtttatatgtatacttgtcataaaaaggattttcaacaggcatataaataatgttctgtttgactttcggatgacgctttatttccacctgattaaataaaaccgtcccttgatccggaagcagaatctgctgaatgagccggagcagtgttgttttccctgatccgttccgcccgagcagcccgaaaatttccccttttccgatggtgagcgaaatatccttgagcacttctttaccgtctatcgtttttgagagattccgcaattcaatcatgatcctttcctcctttcacatcagcgctgatttcctttatccattcctgcagcttctccagctcaactcccgcgtaatgggcatcgatgatgagctgtttcaattgctcttttatcatcgtcatcttcccttcaaccaatgtcgtttttgcattctccgatatatacgttcctcttcccctcagcgtttcaatgacaccatcgcgttcgagctccttgtacgctttgctgactgtgttcggattggcgataatgatcgttgccaattccctgacagaaggaagtttatcccccggcttcatgatcccttttaaacaaagctctttcaattgctgtatgatctgctcataaatcggagttgagcttctcggatcgatttgaatcatttacttcccttctttcttttacgagctgctctctttctttaaatgttctgccattgaaaaccgatgacgacaagaacgacaaacagactgctggccaaaaccgaagcggcgataataagaggcacatcttgttttacggatcttttgtttttcatgaaagttccccttccctatgcttaacatttatatgtcgattcatttttcgagtgttttatgtgtattacatcaagtagtacacgtaatacaataaacacactcaggcctattgtcaattctttttttaaaaaaatacaaaaaaacccgccgggattccggcaggtttgctgaaccatttgaaacggcgcggtcagtaatcaaaattacgctgcaaaatcatgttgttttgcaaggtctgcagctgcaatctcattcggtaaagctgctctctttgctgatcattcgcagataatgacagcttgtttaattcattcaccgcgttttcaagcatcatttgcgcttcactgtactcattatcattataatgctcttgttttgaagcggtcataaattgctcattcgcaaattcatatgcctgttcgcttctttggagatgttcatctactgattgtcttgttgccattaaacagtcctcctattgataatgtcatatcaatagtatttcttattccaaattaattctcacaagaaatatcaggtaattcattcacaagacagagatggcataaaatacgattaaatgtaaaacttaatcaagacagaatgaagtctttataaaaatccttcattttagaacgataacttaattcttcttttattaaaaacatcataatttttccacatcacccacaagatcttcggttcgctttaaattgttcaccattaaattatcttttttgtgtaaaacacccgggattcatcaaattttttagatctgtttttattagctttaattatcatcccgaaactaacaccaactataaaacttactcatccccatctaagactggaacagctttaaattttttcaacaaaccgttcaaaagtgaatcgaattttgaagaattaagataatagtatgttttattttgatttctcgtactctcaactaaaccttgcaatgtcaaaattctcatatgatgtgaaatcgttgcgttggttaaatttagctgttcagcaatctcattagcatacatttttttatgactaagtaagattaatatcttgaacttacttttatccgataaaagcttcaaaaaatcaatgatatgattaatctctgctttctctaatgtattttcaaatattttatcaactttataacccagtccaacataaatgttatcttcacttttcgtaatagttgcagtgcaaggtaaaagtgttggatatatattaatataattacaagataagtattccttaccttttaacgtactgattatcttttttggaaaatctatatttatgttttttaattgattcatccactcatctctgaatttaattaaattataaatcgcctcgttaagataaccattcaccaacattaatttattgcaaaattgatctacataagttttaggagatttcattaccttaaatatgatccacttgtattcgggctttatatttagattattaagtagctcaaataaactttccctatcatttaaatactgttgggtagatgtttcggttttaagatctccttgtaaataaattagagactctaaaatattttttcttatctcttcttctgtaactgcagacaaataatcaataatttcaaaaaaatctttcgtgtaaatttgtggtattttaaaaaatgttgtggctaaacaaaaaatatttgcattcctaacatctttgtagtcgcaaaagctgccaaaataaaaatttaaaaactcactatctaactcttttattcttttaagatcatctaataatacaaaatattcattatctaaattcaaacccaatttggttgtataatctttgaagaattcctcgtgttttaagaatagaatagaggatatcttgtcaaagaattctgaaacactgtcatttattattaaccgcactttttcacaccccataaagtctttttccacaaaggaaaacgttgtactatcttcatgccagacattttacatttttaatattatcaatcaaaaggaaactttcaaagaatattcatttctaattagcacttacctgactgagcattatcatgagcagtcctagatttattagacttgcttcacctcatgctaagtattctcctcatgtcatactcttcagaaatccttaatcatctcagctagtttacaggtccatttaagctcttattgagttatttcaagttacaaaattgttgaattataaaaatatgatttcgagataagtggatgaaaaaacaatttatgaataatattgacacctcttaagattgcatttatcatgtttttagatatatatcgaattttaatttagattaatatctgatggaggttgtagttttgaatttcaaaaaattaattatgttatctgcattattattaggtacattcatttcggtaatggacaccactatagtaaatattgcattacctaagatgctggattacttttcgagcaacctttctcaagtagcttgggtggctacaggttatactttagcttttgcagttttattagtaggtgcatcaaagctggcagaccattttggaagaaaaaaagcttttatgtttggattagcactttttattttgacatcagttattgcctgtttgagcacttcaattgaaatgcttatcacaattagagtgattcagggattatctgctgctttcattgtgccagttacaatgcctattgctttggccatcgttcctcaaaataaaaaaggattgatcattggaatctgggggctttctcaggattagcagctactttaggacctgtacttggaggattattaactgaaaattttaattggcaagctatcttcttcataaatattcctttaggcctgatttctctttttttagcagcattttttattactgagagttatgatgaaacagtgagtaaaaaaattgattacatggggattcttattttatccggagctctcttctgtttaacctttggctttgcaaaagtatctgatttaggctggtcatcaccattaattatctctctttttgtaatctctgtattattattctgtttgtttttctttattgaatctaaaattaaaaacccgatgattcccttatccatgctgaagatacgtacgtttagtttcagttctttcaccctctttatgcagggccttggattaacaagcggtacccttattattactttactcctcacgaatttaatgggaaaaactgaattagaagcggggttaattgtttctacattagctctatcatctatgtttacctctgtactttctggaaagctatctgataaactcgggggcatttggctttcgggtctaggtatgctcggtttaacaatcacaacatatttatatggatacatacgatacgacagttctgtaacaacggtagttattctgttatgtttgaccggcttagctttagggcttgtgataggaccggcaatgagttcagggatacggcttattcctcctgagaaagtaggtattgcctcaggtattcttaatatgatgcggacagttggacaagcgctaggcattgccatacttacatctgtgcttacaatgaatataaatgatcacacagcttctgcaaaaaaagaagccataacaattgtggaaaacaatcaggtttttgataaaaatgcaaaaaacgagataataactcacttaaagcattcagacagtaaaggtttcgatcgaagaaaaagtattgctgaattaaacaaaaaagaggaagaaattctttctataaccccggatccatataaagaaaaggtacaaaaaagtttcaatactcaaaagaaggaagttatcgctatccagaaaaaaatttcaaatttatataatgaaaaaataagtgacagttttaataatacattcaaagtaggcagtgtaattcttattttaggaattatttttgcattgttcagtgatatttctccaaaacgattaaaacaacaacagaaaaaccaggtagatattacgccttgaccgttccataattgtttcattgttccgccccatcattcatgctacaattttaggatgcatctgatgtgagggaggctttttgaacattgaacgagaataacccttttccttattcaaatacggaaaaacggtaccatacattaaattatcatctgcgggagcatttcgggcataaagtgtttaaagtcgcgcttgacggcggttttgactgcccgaatcgggacggcacggttgcacacggcggctgcacattctgcagcgcggcgggctccggcgattttgccggcaaccgggccgatgacttactcacgcaatttcacgatatcaaaaaccgtatgcacgaaaagtggaaagacggtaaatatatcgcatatttccaggcgttcacgaatacgcatgccccggtagaggagctgcgtgaaaaatttgaatccgtcctcaagcttgacggcgttgtcggcatgtctatcgcgacccgtccggactgcctgccggacgatgtcgtggaatatttggcagaactgaatgagcggacctatttgtgggttgaactcgggctgcagaccgtgcatgaacggaccgcactcctgatcaaccgcgcccatgattttgactgctatgttgagggtgtcaataaactgagaaaacacggcatccgcgtttgttcccatatcattaacgggcttccgcttgaaaacagggacatgatgatggagacggccaaagccgtcgctgatttggatgtgcaaggcattaaaattcacctgcttcacttattaaaaggcacaccgatggtgaagcaatatgaaaaaggaaagctggagttcctttctcaagaagaatatgtaagtcttgtatgtgatcagctcgaaatcattcccccggaaatgatcgttcaccgcattacgggagacgggccaatcgaattaatggtcgggccgatgtggagcgtcaataagtgggaagtactgggcgccattcaaaaagagctggaaacacggggaagctatcaaggaaagctcttcagaaagaccggggaggagaccgccctatgaccttgatgcacatcctccctttcagtaaagaattgctgaagtccgccgcacaggaaggtgatatcacggttgacgcgacgatgggcaacggacatgatacatattttctggccggccttgtcggtgagacaggacatgtccatgcctttgatattcaagcggacgcactcgctaaaacgaaggagcggctcggtgccgacttcggcccgcgcgtcacgcttcaccataaaagccatgatcaaataaaggcatcgctgcctgaagatgcgcacggtcgtgtggcttgcgccgtctttaatctcggctatctgccaggcggcgataaaagcattacgacaaacggtcactcaaccatttccgcgatcgaacagctccttgaactgctgaaggagaacgggctgatcgttctcgttgtgtaccacgggcatcctgaaggcaagacggaaaaaagtgcattactggaatactgcagcaatcttgatcaggaaaaagcccgcgtgctgagctacggctttctcaaccagcaaaacgacccgccgtttattatagcgattgaaaagaaatctgccggcaaataaagaatcggcctgtcataagcgggccgattctttttgtatttacttttcaagaaaaatcaattactatgaaataatggaaaaaagttcatcttttaagtgtaacatctgggaggagcggcaatttgaatattcttcgcatcatattttcaagtgttccctatgtgatgtttgtcatcattttatcaagacatttaggatttgagttcgcgaaaacctattactggtggtttgctgcattttttgtcatcgggctgatcggcaaattcgcaatgcaccttgcggcaaaaaagaaaccgttaaaaaaagagacagcgtaaaatgcgcatgtctctttttatttactgttttgcagcacgctgcgtgtataagcgggattgttcgtaaagacaccatctgctttttgtttcagcataataggcgtcagcgtatgctcgtcttccttatcaaaaaacacgtgcactttcatcttattgtgatgaatgcgcttcacgactgcttcatttgccaatttggcgttgatcccgactgtatcagcatacgttctgatggtttgcagctgcttatcatttatctcctcagcctcgttatcttttaataatcgaacaagaggaacttttttattcatagaacgaactttctttaagctcttcccgctaaaagactcaatgactgctttatggccggaaatcagcttatgtttttgtaatatgtcaatcagtttcttttccatcaccaggctgccgttgctttctcttgtctcaatatagtaattggcagtttgtccgaatttctgtatgatttcttctaatgttaaaatcttttctccttttcccgcattcagtttcttaatctgagccaaagacagatcatctgtcatccctttaccatctgttgtccggtctaccgttttatcgtgaattgcaatcagacggccgtccttcgtctcccgtaagtctatctcaatataatctgctttgtctttaatcgcacgtgcataagacaaagcggtatgttccggctcaatcgcagaagagcccctgtgcgctatcaagacaggatgatagccggcggaagcatgggtgacggagcagcctccggaaatggaaagtaatgctatgaccgctaaatactttaattttttcataaaattaaagtatcatattctgcaggcgcacacaatgtttcattcttcacatcataaataaaaaactgcgccgtcatgatgtacacgagaggcgcagttcacccattacgaacttttcgtccaagccatcttctgaaatttgcggtaggctcttccgttgatataaaagaaaaatgacgtttttccgcttgccctgatcagctttcgcgcgaggcggcccatttctttttggccggcgactttgtcatcggataaatagacgccgagcagccccctgttgatcagccggtgaaaattttcatgcggaatgccttgcaaatgttcatccgctttttcaataaaatgctgcagtctctgcatcatttcttcatgagactgataatacgtacagaaattcagatcgccttcaagcagatcttcttcctggtcaattaaataatcaagcagtatatgcaggccttgtatgtacggaaaataactgctgcggattttctcagcggtatgttcgttaaaatcaggctggaatgagtaagcaacgagacagaaaatgcctaacgtcgatccggcgcaggccgagaattcaaaccactccatttccggaagctgcgacctgtactgctcaaaccaggctttaagcctcggaacccgttcatgctcaacgacatgcttatgaacctgaagatcgcaataataatcacacagttcaagcaaataaggtttaatgataccgtaatgttctattgacccgagcacccgctggcatgttctgaccagttcatgaagataaccgccgtcatcccgctcctctctgtactgatagtacggccgcacctcggcaccgaccgtcagcgcgtcacgcatggaaagatgaagcatgcggaagtcctccggatcaagcgaggtgctgcggtcgcacagattgtccagataatcactgattgtctgatacgcgatgataaattgcacgcatttctgtttctgctctcccgaaagcagggctaaaatgccgcctccttcacaatgaaacgacttatcgcggatacttgcggccgcctgctgccgcagttcggtatttttaatggaatctgatttttcccgccacatgttcaattcctgatgaacgagcggaaaaatttcccgatacacttttgccataaggttaaaaggatgttccggtactgtcaacatatgcaccccagcgaattcaaatatactgatctgtaaaggcttttgccgccttaaacacagtttctctttcaggttcattaaatatttcatgataaagcccttcccattcccggtacgatttattatgggaagccacaccggaaaaccatttgcggactttcattttatcgacgattttgtcatcaccgccctgcataagcaaaagcggcacctttaaaaacgcatcagtcggcaccatagcggcatcaatggtttttaaaagctctctgtaccatcttacggataccttcgtgacatataaagaatcgttttgatccgcttcaatcatatccgcattcctcgttgccatatcaggtgataagccggaatccactctgagggacggagcgaggacgttcagtcctttagacgcaaaatcaaggactttattgacttttatttgcagacccagacaaggtgatgataaaatgagtgccgtaatgcggggatttctctgctgcttaaaccattctatcgcaatcagtccgcccatgctgtggcccaaaaggaaaacgggcgcttcaagcgttctcgctttatcaatccatatatctacttcatcaatgtattcttggaaagagcgaatatgccctcgggcgcgggtcgacgttccctgaccgggcaaatcgcccatcaccacgttatatccggaagatctccacatttcaacgagccatttataacgcccgtggtattcgctcgccccgtggataatgacaatggtaccgacgggcctgtctgctttccaagtccacatgcagttcacctcttacataaatttagagaaagaaggatgagacatgataatctacccttataaacaatttacgcctgacgtacatcctgaagcgttcattgcggataacgccgtcataacgggcgacgtcgtgatcggagaacaatcgagcatttggttctcggcagtcatccgggggatgttgcgccgacaaggatcggaaaaagagtcagcatacaagacttgagctgtctgcatcaaagcccgaaccgcccgcttcttattgaagatgacgtcacgatcggccatcaggttacactgcacagcgcaatcatcagaaagaatgctttaatcggtatgggctccgtcattcttgacggggcggaaatcggagaaggcgcgtttatcggcgccggaagtctcgttcctccgggcaaaaccattcctcccggctgtcttgcgttcggccggcccgcaaaggttatccgccggctgacagaagaagacatacgggacatggaaagaatcagaacggaatatgttgaaaaaggccgatactataaaacaatgcaagagaaataaaaaagatcagctttgttttactactgtaccatttttcaaaatattatttaagtaaaaaccatttgcattctcccgattgtcaggaaacagaagcaaaatgttcaggaatttgttttattcttcccccttttacccgatcctatgaaaaaagagcccatttcagcgggctcttttttacgctttttcggcgaatgtctgtccgttttccagatctatgtcttttcttttatggaatcctttgccgtaataggcggctaataatatgccgaaccagacaggaccgatgatgacggccaccctggtctctgcatcaaaagccatcagcacaacgacaaaagccagaaatgccagcgagatatatgaggaaaaggggtataaaggcattttatatttgagttttttccgttcttccggctgtaagcttttacggtatttcatttgggaaagcaaaataatcgaccatgtccaaattgctccgaacgtcgcaatgctcgtcacccacgtaaacactttcgccggcaccacgtagttcagcaaaacgccgatgcataacgcacccgctgaaaccaataccgcttttcccggcacaccgccttttgtgaccgtaccgtatgctttaggcgcttcattttgctccgccagattgaacagcatacgccccgtgctgaagatcccgctgttgcaggaagaaagagccgccgtcaatacgacaaaattaatgattccggctgcagcgggtattccgattttttcaaatgtcaaaacaaacgggcttccgcctgaaccgatttcctgccacggataaattgacataatgacaaacaaagctccgacgtaaaaaatgagaatgcgccaaaaaacagtatctatggcccgcgccagtgatttttccggatttttgacctcaccggctgtgacaccgatcagctcaatcccgagataagcaaacatgaccatctgaagcgacagcagcacccctttaatcccattcgggaaaaagccgccgtggctccataaattgctgattccgagcgcaacgcctccgtttccgagaccgaatacgatcatcaccagaccgatcgcgatcattgacagaatcgccaagactttaatgagcgcaaaccagaattcaagctcaccgtacgctttgaccgccagaaagttgacagccgtcataatgacgagtgcacaaagcgcccagatccatgacggcacgtcagggaaccagtagcccatataaatgccgaccgcggtgatttccgccatgcaggtaacgacccataaaaaccaataattccagcctgttaaaaacccggcaagcgggccgatataatctctggcataccggctgaatgaaccggctacaggcttttgaatcgccatttcccccaatgcccgcataataaaaaacataatcagtccgctgcaggcgtaagcggctaaaatccccggcccggcaagctttatggcagaagcagacccgagaaacagcccgactccaatcgcggcgcccaacgacataagcgagatatgccgctcttccaagccgcggtgaagcgttttttctttgttttgcataactctccctccccctgattttgacaaagaaacaacaaaccgagacgaaatagccagaaaactttttccggaatctacccgattagtcctattataacctttttctgaatattgcgtaatactttgtcgaaaacagagcggaatagacggtttacaaaaaacaatagaaaaaaggctttcgataactcgaaagccttttggattaaacgaaaatgacttctttcggctgatgattcagctcttccggcaccagtcttttttcgacattgatgctgtgccagatcatgaagatcagcacggtccagattttgcggctgttgtccgctctgtcggcacaatgatcttccagaagctgaaggacataatccttttcaatataagcgtctgtttcactttcgcgaatgatgttgcgaacccattcgttcatttcatttttcagccagtggcggatcggcacagggaagccgagttttttgcggttaagcacatgatcaggcactaccccttcagcagctttgcgcagaaggtatttcgtcgtgccgtttttcgttttcaattcatccggaatttttgaagctacgtcaaacacgactttatcaaggaacggcacgcgcagttccaatgagttggccatcgtcattttgtcagcctttaacaggatgtcgccgcgcatccacgtatggatgtcaacatactgcattttatttatgtcgctgtatgaacggctttccgtaaagtacggcttcgtgacatcacggtatgaaagctctggattgtaatgtttgagcagctgttttttcacgggctcttcaaaaatcttcgcattaccgatatagcgctcctcaagcggtgtgcagccgcggactaagaggcttttccctctcattccttcaggcatgacggacgccacatgaagaagcatttttttcagaccggacggaatgcgttcaaacggtttaagcgaaagcggttcgcggtaaatattgtacccgccgaacagctcgtccgcgccttccccggataacgcgaccgttacatgctttttcgcttctttcgcgacaaagtacaaaggaatcgccgccggatctgcaagcgggtcatcaaagtgccagacgattttcggaagctcgttcatatactcctcaggagaaatgactttgctgatattttcaataccaagcgcggcagccgtttccttcgctacgtcaacctcactaaagccctgctgctcaaaaccgacggaaaatgttttaaggctcgggtgaaattctttcgcaactgaaacgataaaagaagagtcgataccgccggatagaaacgaaccgacaggaacgtcacttctcatgtgaactttgacagagtcaaagattgcgtctctgacttctttcaccaatttatcttcatcagactgaacaggcttgaagttcgctttgaaatatgttttaaacgcgatgtcgccttccgggcggatcgtaaactggctgcccggctcgacttttttcacttcagcgtcaagcgtgctcggttcaggaacgaattggaaagacatatattgctgtaaagaagctgtatcaagatcaataccgttttgagcggccattaaactctttctttcagatgcaaaatatactttgtccccgatggttgtgtaatacagcggtttaattccgaacgggtctctcgcgccgtacatgacgcggtcagctttgttccagattaaaaacgcaaacattccgcgaagctttgaagcggcttcttctttataatgacggtatgtcgcaaggagcacttcggtatcggaatctgtattgaaagtgtagcctttcgcttcaagctcttctctcaattcaatgtagttatagatttcgccgttaaaaatgatccaatatttttcgtcttcatatgataaaggctgtccgccgttttctacgtcaataatactgagccgtctgaagccgaatccgacgtgctcgtcatgataatacccatcgctgtcaggaccgcggtgaacgatcatttggttcatttgtttgattagctcttcttgatctgcggtttgagttaatggatgcttattaaaaacaccgacaaatccacacatagtatagcctccataagtgtaattttctaattggaccccctttttatagacgctttgttacgccattggtttcacgctatgtaaaaaataagcatggcagcatctacaaaaagggaaagccgcttaagtaagcggctataaaattattctcctagtgcttctttgcgaagcgcatccgccttgtcagtacgctcccaaggaagatccacatcatgacgtccgaagtggccgtaagcagctgtctgcttatagatcgggcggcgcagatcaagcattttaataatgccggcaggtctcaggtcgaagttattccgtacgacttcgatcagtttttcttcagaagcttttcctgtatcaaatgtattgatggaaatagaaacaggctgtgccacgccgattgcgtatgcaagctgcacttcacaagaatcagcaagacctgctgccacgatgtttttcgctacgtatctcgcagcgtatgccgctgaacggtctaccttcgtcgcatccttaccggagaatgcgccgccgccgtgacgtgcatatccgccgtatgtgtcaacgatgattttacggcccgtaagacccgcatcaccttgaggcccgccgattacgaaacgtcccgtagggttgatgaagtattttgtttcttcatcgatcagttcctcaggcacgacagggttaatgacatgctctttcagattgcgctgaatctgctcaagcgtaatttccgggtggtgctgagttgaaataacgatcgcgtcgatgcggaccggcttgttgttttcatcatattcaacggtaacttgcgttttgccgtcagggcgaaggtacggaagaatgtcttctttgcggacttcgctcaaacggcgggctagtttatgcgccaaagagatcggaagcggcataagctctttcgtttcgttacacgcataaccaaacatcaggccttggtctcccgctccgattgcttcgatttcagcatcgctcattgtgccttcacgcgcttcaagtgcctgatcgacacccattgcgatatccgcagactgttcatcaattgatgttaaaacagcgcaagtctccgcatcaaatccgtatttggcgcgtgtgtagccgatttctttaatcgtttcacggactgttttcggaatgtcaacgtatgttgacgtagtaatctctccgcttaccagcacaagtcctgtcgttacagatgtttcgcaggccacgcgcgcgttcgggtcattttttaaaatctcatctaagatactgtcagaaatttggtcacagattttgtccggatgaccctcagtaacagattcagatgtaaatagtcgacggtttttactcattcacttttcctcctgaaaaaagatcttttgcaagaccttctcatatgatacggaactcgctccctcttaatacaatgtcatactatatcagagaatgttaattggcatattttatgaaataaaaaaaccttttccactcgaggaaagggtttggtctgtgtgcctttcactcttatcgctcaaggaaaatattaaaccttgcatcaggttagcaccttggtttcccacagtgttttcacctgcttttttacagagaaaccggttgctgggcttcatcgggcctgtccctccgccagctcgggataagagtatccgctcaatgaaatatcttatcgtaaaagggcggaaagtgtcaatatgaattaaagcgattgcgcgcctttatttcgggaagcaatggaaaaacacaaacaaaaaaccgtaaatagtatagactattttcagatatatgttatactaattccacattcagcgaaatacaaataaaccggcaaaggaaggtttttatgaaattagttgatttaaccgcagatcttcaagcattacttgcaagtccgaatgtgcatcataatttatcggctccaaaacttaccgaaaaagtgatcagccgaaatgaaggaacgctgacatcaacgggcgccgtacgcgccactaccggcgcatatacaggccggtcacctaaagataaatttatcgtccgtgaacaaagcacagaaaatcaaattgattggggcgcggtgaatcagcccatttctgaagaggcgtttgaaaagctgtacgccaaagtcgtcagctacttaaaacagcgggatgaactgtttgtgtttgaaggattcgcgggagcggatgaaaaatacagactgccgattacggtcgtaaatgaatttgcgtggcacaatttattcgcgcgccagctgtttatcagaccggaaacggatgaaagagacccgcaagcgcagcctttcaccattctctcagctccgcattttaaagcagacccggagacggacggcacgcattcggaaacatttatcattgtctctttcgaaaagcgcgtcattttaatcgggggcaccgaatacgccggagaaatgaaaaaatcaatattctccattatgaacttcctgcttccgcagcaggatatactgccgatgcactgctcagccaacgtcggtgaaaaaggcgatgtcgccctgtttttcggcctttccggcacagggaaaacgacgctttcagccgatgcggaccgcaaactgatcggagatgacgagcacggctggtcagattccggcgttttcaacattgaaggcggatgttacgctaaatgtatcaatctgagcgaggaaaaagaaccgcagatttttcgtgcgatccgcttcgggtctgttcttgagaatgtcgtgcttgatgaaaaaacgggtgaagcggattacgacaattccttctacacggaaaacacaagagccgcatatccgattgagatgatcggcaatatcgtgcagccgagcattgccggccatccgcaggcgatcgtctttctaacggcggacgcattcggcgtgcttcctccgatcagcaaactgacgaaggaacaggcgatgtatcacttcttaagcggatacaccagtaaactcgcgggaaccgaacgcggcgtgacatctccgcaaacgactttctcgacgtgcttcggttcaccgttccttccgcttccggcgcatgtatatgccgaaatgctcgggcgtaaaatcgacgaacacggcgttcaagtcttcctggtcaacacaggctggaccggcggagggtacggagtcggagaacggatgaaactttcgtatacaagagcgatggtcaaggccgctattgacggcagactgaaccagactgacatgacggcagacagcattttcggcctgcacagtcccgttcatgttccgggcgtgccggatgaagttcttcagcctgaaaacacatggagcgataaacaagcatacaacgaaaaagcgctgtttttagccaatgagtttaaagaaaactttaaaaagttttcccatgcagactcgattgccaaaaccggcggacctctcgtgtaatcaaaaaagccaagggcgtttatgccctcggcttttgttttttcagtttgtcgaatgaagcgaagtgagtctgtatgtaatgcttgtccggccgttcgcccattcgagcttctggacctcgccggtgccggatttctcgccggttttcgttttgcgcacgtccatcggaatatcaagaggatagacgcggtagccctctttctccaataaaaagatattttcctctatccgtttttcattgccttttgtcacaatcatggtattaaattcaacaggcattcccaaaatgaaaatcccctttcattctcttattctttattatcatatcataaatcaggcatcttaccgtgtcttcatccattccgccagccgccggacaatgcgtctgttttcctgcggcggaaaataatgcgtaaaaccgctgtaataccaagtttccaccggtttccccgcctctttcagcttgtcctcgatcatccgggcgtgttcgatcgaaacattttcatcattctctccatggatgagcagcacaggggcctgaatgcggtctgctttttcaaacggcgaacgccatctgtattcatccggcacctttttcggcgtgccgccgatcacccgcttcatcatccgccgcatatccttccgctcttcataagtcagcaccatatcgctcacaccgccccatgaaacgagtgaagccgcttgatgccccatttcaatcgcggtcaaaagccccatgattccgccccgggaaaaaccgaaaatatgcacccgcccttccctgacgttcggatgctcccgaagcaggcggaaagcggaaaacgcgtcctctctgtcctctcccgcaaaatcttcatttccctcgccgccctggttgcctctgtaataaggcgcaaacacgacaaagccttgggaagcgaattgaacgattctcccggggcgtaccatgccgacattttttatgccgccgcgcaaatataaaaaaccgtcatatgttcccggcgccgcaggctcggcaaggagcccctttaccttcagcccttctgactcatagcataccgcaaagaggcggacatgcggactcggagacgggaaccttttcttttctaccagcaaaacaatgcgcctccttagatcatcagtttttttattctttcccaacgtgaatatgggcactcacacattttttatacccatcatacgatatgtaaagcagaaaaggttattttaacgcttaaaacaaggaggttacaccgtgaacaaatggctcaaagcgggctgcgtttttgtcatatgcgcctttttcctgctcattcttccggcttgcagacaggaagaaagtctgacgaaggtaaaggtggcggaagtcacacactccatcttctatacgcctctgtatgtcgctgaagcaaaagatttctttaaaaaagaagggctccaagtgtcacttcaaacaacatggggcggagacaaaacgatgacatcgcttttgtcaaacgggtcagacatcgcgctggtcggttctgaaacatccatttacgtggaggcgcagggagcaaaagatccggtcatcaatttcgcgcagctgacgcagacggatggcacatttctcgtgtcgcggaaggatgagaaatcattcaaatggaacgatttaaaaggaaaaacatttctcggccagcgaaaaggcggcatgccccaaatggccggtgagtacgtcctgaaaaagaatcacatagagccgaaaaaagacattaacctcgttcaaaacattgatttcgccaatatttccaacgcattcgcatccggaacgggtgattatgtgcagctgtttgaaccgacggcatcccaatttgaaaaagaaggcatcggtcatatcgtcgcatccttcggagaagcttccggccaagtgccatacacaacctttatggcaaaagaaagttatttgaaaaacaatgaaaagacggcggaaaaattcacccgcgccatctatcgcgcccagcaatgggtggaaagccatccggccaaagacatcgcaaaaacgattcagaaggaatttgccgatacagacccggccattatcgaaacatcgatagagcgctataaaaaacaaaagtcattctctgcagacccagttctgcaaaaggatgaatgggaactgcttcaatctattatggatgaagccggagagctcccgaaacacattccgtacagcaaactcgtcaacacaaaaatcgccaaaaaagtcacctcagaacaataggaggaacatgaatgtcttttttacatgtggatcatgtaacacatacttatttctcgcttaaagaaaagacaaccgccgtgaaagatatacattttcagattgaaaaaggggatttcatctcctttctcgggccgagcggatgcggaaaaacaacactcctgtccattctggccggccttatcacccctgcgcaaggccgggtgctgatcgaaggaagcgtgccgaaccataaagaacaccaaatcggttatatgcttcagcaggattatttatttccttggaaatcgattgaggaaaacgtgctgctcggtttacacatttcaaaaacattaacagaagaaaaaagagctgaagttctcagccttctgcctaagctcggattaatcggcgttgaaaagaaatatccgaaagagctctcaggcggaatgcggcagcgggcggcacttgccagaactcttgcgccggaccctggactgctgctccttgatgaaccgttttccgcgctggactttcaaacgaagctttctttggaaaaccttgtcttcagaacattaaaggattttcaaaaaaccgccgtgctcgtcacccacgatatcggtgaagccatcgccatgagcgatacgatctatttattttcgaatcagccgggcaccatccaccaaatattcaccgtgcctaaggagctcgcggctttagatccgtttgacgcgcgtcaggatccggcctttcagccgctgtttcaaaccatatggaaggagctgaattcccttgaaaaacagcagcggcacgattgaacagcttcatcagcagtttaagaaaagacaccaaaaagaaaagctccggatccgtgcgtatcaggccgccattttcatcgtattttttgccgggtgggaaatatcgagcagggcgggctggatcgatccgttaatcttcagctcaccctccgccgtttgcaggcttttagttgaaaagattgcggacggatcccttgcggcgcacatcggcgtaaccttaggagaaaccgttctcggctttttgctcggcacgcttctcggcacatgcctcgccgctctgttatggtggtcaaacagactcgcccgggttttagacccgtacctcgtcattttaaacgcgatgccgaaggtcgcactcggaccgattctcatcgtggcactcggaccgaatttcacaagcattgtcgccatgggagcagtcatcagtgtcattatcacgacaatcgtcgtctttacggcttttcaggaagtggatgaaaactatattaaggtgatgaaaaccttcggagcgaaaagaagcatcatgtttaaagaagtcattctgccggcatgcgcccccgcgattatttccgcgcttaaagtgaacgtcggtttatcctgggtcggtgtcatcgtcggcgagtttctcgtttccgaaaaaggtctgggctacatgatcatttacggattccaggtcttcaatttcactcttgtgttcttaagccttctgatcatcgcgatttttgcgacattgatgtatcagggagtcgaactgttagaaagaaaatggacgaaaggaaaaatataaaaaagacccgtgcgtaagcgccgggtctccgttttttatgattgaaatacgccgtcctctttcagctttttcagactgatcggaagcaccgaatctttcataatgaaactgaattttttatttcgggggagattctccggcagttcgctgaacagcaccggcccctttgtttcaaaatagtcagcctgtttttcaagcttttcaatatcggcaaaataaatattcttcacgattaccttttccctgccgagaactttatactgtccgacgtacttcagatgtcttaccgcggcgccggtttcttctttcacctcgcgcagggccgcttcctccgcacattccatcggctccacttttccgcccggaaattcaaacccccggtcttcgtgctcagtcaaaagccacttatctccatatcggcatatgacccatacatgcttcgggctgtctgaaaaaggctggtgttcaaaggagagctgaacagtattctgataatagtctttaaactcgtacatgtttatccctctaatccgttccttcatatcttccatacatcataccacagttgcgtttgttcggaagccctttatcaaaaattcagaggaaaaccatcatacccgctagtatagcctcctttgaagcaaatgttacggtttgcgcttgaatttatttttcaaagtatccaataggtcgacgagcacctgcggaaccgggatgcccagcgagcttgccgtaatcacgatctgaaccgattcgtataagatataaaacataatagccaaattgcggatggcgccttctgaatgaagcagctgatcaaaaaaatggcaaactgagactaatgccagggtcacgatttttttgaccagccgcgcaaaaagctttcttgcgctcagctgctgcaaaagagattcttttaagcttgtactgataaactcaatcgccatgaccgatagcaaaatcagaaacgaatactgaaaaccgccaaagaaaaaccccgctgccgacacgatcactgcaaaaaacgaaaagatgccaaagtctttgcccacttgatccaacatcctttcacagaaacggccttacattattctatgaaaagtgaatggaacggactggatttttcagaaaaatggacaacacctctcttcggcagccaaataaaagaccgagtgctttatagccccggtcttcccttgttgattatcctaaatacgctttcagcatccaattatgtttttcgatattctggtgaatggcaagcagcatatctccggtcgtttcgtctccgacctcatctgcgagatccatgccgcttttcagctcttccgcaatgacagtgaaatcatcataaatgttctgtaccatttgttctgcgctctcattgccttccgcctcttttatagaagcactcttcaatgattccgtcattgtgccgatcggcttgccgttcaatgccagcagacgttctgccagatcatcaatatatgtagccgtttcgttatacagctcctcgaacttttcgtgcaatgtgaaaaagtccttccctttgacgtaccaatgatagttatgtaatttcacatacatgaccgtccagtttgcaacttgtttattgaccgcttccaatagtttttctgacatgcctatcttcctcctttgatttactattgatataccctatatatcgtgtgttaaaacataaatttttagcccttgattttacggatggaaaatatgttatgatttgttaaaaaggagggatttcatgctgcttcttctgagcttcggctttcttatcgtgctcgccgtgctgcttttatccatctggtcgactgtaagagcttataacgtaaaacatacgattgacccgccggaggacgcatcaaaaggcttgacggataaaaacaatccttaatgatgatgcgtctgttcctcatggccggaggaatcatcggcagcttcagcatccccgacacgtacttttacagtcggcatattatgctgctgttttgccgttacgtgggattgaacggtatacacaccctcttcatcaaattcagtccgcaggtgatacgcccctttttcctccttggccttgcttgttttgctgctgcctttttttccttctttccatacttcaaacatgacttcatccgcatccgtgacacgcttgccgccgtaaaaaacctccgccttgtattccgttttttcatgcggtgctgccgtttccggtcctgtaagcttgacctcaagcgctttaggctcctcatccgcggcggttttgtccgaattgcccccgcaggaagataatagaaataccataccgcacatacctgccaatacagcccgtttcatcccatcactccttcatgtttgcttctattttagcaaacgcttacacataaggtgtgacattttttagaaatatgtaaaaaagcctttttgcatgtcagcaaaaaggcctgttttttatccgaacactttcagcaaatcttctttatcttgtgacagccagaaacgcatcagccgtttcgcgccttctaaatcatgaagtttcgcctggccgcactgtttttcgttggccgccggaatctccgtaatatcgatggcttctttcagcgtagcgtctagcaggtctacaatttcttccgctgtaggctcgccgctgacaacaagataatagcctgtctggcagcccatcggtgagatatctatgatgtcgaagtgatcgtatttctcagaatgtgtgcgaatcgtaaacgcaagcaagtgctcaagcgtatgaatcgtatccggcttcatcgcctgtttgttcggctggcagaagcgaatgtcaaacttattcacgacgccgtctgttccgactttatgcactccgcaatgtcttacatacggagccacaaccgcattatggtctagctcaaaactttctactgaaggcataatggcactccctttttttcagaatatgcatccattataacacagttttccgataagaattgtggcgaaagcttttcaatctgaaattttttttctatactagcatcagaaaggtggttttttaatgaaaaccataatgattgcgctcatccgcggataccagaagttcatctctccgctgacgccgccgtcatgccgcttttatccgacgtgttcacagtacggaatcgaagccgtcaagactcacggcgcattaaaaggcggatggctgacactgaagcggattttaaagtgccacccttttcatccgggcggtgttgatcccgtaccggacaaaaaacgaaaacattagtccatatgctggtagccgtcgatcaccagatcaagtttaccggtttcaggatcaatcaccagaccgtgcaccgggacattgtcagggaatagcggatggtgtttaatgacgtttacgctgtctgtaacactcgcttctactgaatcaaagcttttcagccattgatcaagatcaacacctgagtgcttcagcatgtcaatccgctctttcggaataccgcggtcgataattttatcaagcatatcctcgctgttgattttgctcatgccgcaatcatggtggccgataacgcagacttcatcagcgtttaattcgtatacggccactaaaaggctgcgcatgatgcttccgaacgggtgggcgacaagcgcgccggcacttttaataattttcacatcgccgtttcgcatgttcatcgcatgcggaagcaattctacaagacgtgtgtccatacaggacaaaattgccatctttttatccgggaatttagatgtttggtatttttcataatctttgtttttagtgaactgctcattaaattgcatgatatcgtttagaagactcatcttggtgtttcctttctgcttttttattcacaatataacataaggcgggtcatttcgtcactccccgcacgagatgataaagtgctcaataaataagacaaaccctattgggcttgtcttatttccccatattgtattttttgttgaactgttcgactctcccgcctttttcgttgaatttttggcggcccgtataaaacggatgcgtatctgagctgacttccactttaatcagcgggtatgtttttccgtcttcccactctgccgtttcctctgacgttttcgtagaatggcttaaaaagcggtagccgctgttcacatcttgaaaaatcacttggtggttatccggatgaatatcttttttcatggtgatctccctttcttaaatcgtaataattacgttttattctaaaccttaaataggcgcttgtcaatcatatatgccctgatcccttgatttctaaaccctgcacatatatggaatcggaagaataatctaatcgcttcagcaaataatataaccacattacataaaacggtaatttagaaaggcggtttatgatcgtggatgatttagtattagccagaagtctgttcgggacaaccatgggctttcatattatttttgcgacgcttggtgtcggcttgcctctgatgattttaatggccgaattgatttatcaaaaaacaaaagatccgcattatgccattatggcgaaaaggtggacgaaggcgcaggctgttctgctcggcgtggcgataccgaccggaacgatcgcgggtacacagcttgcccttttgtggcccggattcatggagatcatcggcagggtgatgtcacttccgtttcagattgaaatttatgctttctttatcgaagcgctgtttatgtccatttatgtctacgccgctgaccggctgactccggcgatgcgcatcattgccgttattttcgttttgatcggcgccgcggcatccgccgtcttaatcacaaatgttcacgcatttgaaggaacgccggccggctttaaaattttaaacggcaaaatcactgacgtcgaaccgtgggcagcgttttttaatccaagctttttcaccaccgcgggccatgtcgtactgacggctttcatgaccggtgcatttatcgtcgcgtcagttgcggcttataaaatgctgagaacgagaaaacaggagcaggtataccgctttcaccgaaaagcgctgctgctcgctttaacgatcggcgggatattctctattattgcttctttaaacggtcacgagtcagcccagcttctttacgaataccagcctgagaagcttgcgggcgcagaagggctgtttgaaactagatcacacgctccgcttgcgatcgggggttttactgatgcaaaagaagaaaaagtaaaatgggcgatagaagtgccgtgggctttaagctttttggccgcaaacagctttgataccgtcgtcaaaggattgaacgcgtttccgaaagacgagtggccgcctttattcatccatacactgtttaacggaatggtcggcatcgggatgctgctcattttgtactccatcatcggcatcgtgtggagaaaaattttaaagaaagacagctttccgacttggcttttgattttatttttaaccgcaggaccgctcagtctgatcggaattgaattcgggtggatattcgcttgtacggggcggcagccatgggtgatttaccatctcctgaaaacgtctgatgtcgtcacgacaaccggttcaatcggtttgctgttcatcctgttcacagtggtttacgccattttggcagccgcagtcatttatgtgctgctttattatttccgcaaacatcctgttgaggaggatgtaaaagcggcggaatcctaacaatagaaagggctgaattgaaatggacattaccatggatgctctcattgcgatatcaatcgtatggggcttcgtgtttatctacgcggtcatggcaacgatggacttcggagccggcttttggtcgatgatatatttaaataaagaacaaacaaaggcgacaaacatcgccaaccgttatttgtccccgacatgggaagtgaccaacgtctttatcgtcgcgatcgttgtcgccctattcagcttctttccaggggcaaccttcgtgctgggaaccgttttattgatcccgggaagtattattttgctgctcttagccatccgcagcggctttctcgtcttctccaatacggcgaaggaaagaaaaatcatgagatatatctccggaatttcaggcttcattattcccgctgtgctgattttggtccttccggtcacacacggagggtttattgagaagacgggcggagtgtatcacctgaatttggcaaatgtctttacaagtcttaatgcgtatgcgtttatcggctttgccattttaagcactttatttttatcttcactgcttctggccgatttttcaaatgttgcggaagaggagcatgcgtaccgcatctacagacggagctctttaataacagggccgctgtcgcttctgtttgccttcttcattatgctgacattacgctctgaagccggctggctgtatacggggatgatgaaagacaagacatggctcattctgtctgtcattacatttatcattgccggcgtggctctgtttttgccgaataagcgcttcggccgcaacctcggcaaaccgagaatcgccatgatcgccattgcgctccaatactttctggcaagctatgcatacggacgggctcatcttccttatatgatttatccggatattacggtcatgtcaggatttacggagccggcaaccttcagggcgctgtttatgacgtatatcgtcgctttcatcattttgttccccgggttttatttcttctggaagctctttatgaaagacagacgttatatccgccaggaggaataacaaaaatcagggcggctcatactaatggcgtaccttttatcttggaggggagccagcatggaccaaaaaattctgtgtgaagtcaataactgttcatattggggcagaggaaacaaatgcacggccgacgctatttatgtggtcagccatacaggcgaaaccgctgaaaaaagtgaagaaacggattgcaaaacctttaaaccgcaagatttataaaagaaaagagctgttttatacagctctttttcatttccgccgcaagcctccctgagccggagaaaaccgcgcggatgagaagcatggcaaaaaggcggttcggcggcaaatataggcggcagacggtacaatcagtatcgcattcatgacaagctcagaattttttatcaagatgtacatgtttgccccagccggaaagcagcacctgcgttgtaaagccggcactgtttgaagaataaaaaaatcatcgcatccgcctattaaaaaaaccggctgatacagccggttcaaacgggggaaggggtgataatgaacagcttcaatataacagcagcgtacaggcagctcaactcgctgaaatgtctttttatcagttgtttgtcgtaaaaacgtccatttgggtgacgtattttctcattatttcctgattgacttcaacacctagtccgggaccgtccgggacagagatgaatccctcttcgatacggatatcgggagtgacaatatcctcctcccagtatcggtctgatgaggaaatatcacccggtatcgtaaattgcggcagcgaagcaagcgcgactgtctgcgctctcgaaatgccggtttcaaacattccgccgcaccaaaccggcatgtgatgctctctgcataagtcatgtatttttaatgcctctgtcaggcctcctacacgcgccggttttatgttaatgattttacagctcccaagctcaatcgcccgccttgcgtcatcataagagcatatgctttcatcaaggcataccgcggttcttaagtgtttctgcaggtggcggtgatcgacaatatcatctgcctgaagcggctgttctatcatcatgagctggaattcatccaactctttcagcctgctgatgtctttcagttcataagccgagttggcatccgccatcagcggcacgttcggaaaacggctgcggatggctctgaccagatcaacgtcatggccgggctgaatttttatttttatacgttgataaccttcttttacgtattgctcaatttcccgaagcatctcatcagccgaagccagacccaccgccacgccggcgggcactttatctcttttgccccctaaggcttctgcgagagatatcccctttttcttggcatatagatcccacacggctgattcaagccccgcttttgccatgcggtttcctttgaaacgcgcgagactgtcaggcacttctgacggatggaaaaacgcgcggcctacgacatttgggatgaaaaaatctctcagcatatgcgcgcatgtctgaatcgtttcttctgtataccacggagaagaaaacgccgatacctcccccagccggttctcccggtttcgtcgatcgcttccacgatcaaaaatttacgatcctgcagcgtttcaatacttgttttaaacggttttttcagcctcatacttacatgataaagggtgattttttcaatcttaatcatgacaattctcctttacgaagctcattcagccgatgcctcatcagtttattggacgcgttccgcgggagcccgtcaaccttgaaaaaagcagctggtattttatattttgcaagccgctcacggcaaaaggcggtcagctcctcagaactgacagaagaagtcagcacgagaaaagcatgcggcactttcccccacttcggatcttcggctcccgaaacaccggcctccgctacagccggatgggcaagcagcgccgcttccacttctgcggggtagatgttctctccgcctgaaatgatgaggtccgaccgcctgtccagcacgtataaaaacccttcatcatccaaatagccaagatcgcccgttttgaaccatccattatgaaaagcggcctggttcgcgtcgtcacgatgataataccctttcattacattcgggcctttcaccgtaatttcaccatgttcaaacggcgcacaagggtttccgtctttttcaattctaatttcgcatgaaaacagcggtttaccggccgagccgagcttgtccatgctgaattccggagaaagtgtgacaatctgtgagcaggtttcagtcaagccgtaagattggaataccggaaattgtttcctgcggcattcttcaaggagcggcagcggtgccggacccccgccaagcagaatgcagcgcagtgattcaggacattgttcagtttccgcaagcaggcccgagagcatggtctgcaccgctgaaatgatcgtgacctgatgggagctgatgctgtccagcacatcagtgacagagaatttttgatgaagcacgacgggcatgccgtaaatgaccgacttaaacagcgcagacagaccgctgatatgaaacagcggcagcgcaataagccagcggtcccgctccgtgacccccagattcagcgcagacgatacagcgctggaataatgattaccgaaagtctgctgcacccctttcggccttcctgttgttcctgacgtatacataagagtcgccgtatcatcaagcgttacataagcttccggctccatgtcacccgcctcttcagcctgcagctcgtccacatctgcggtggcgaccgcagattcatattcttcgcggcaaaaaccgtcctccgtcaataaaagctttgcctgtgaatcttcgagctgaaacaaccgttcctgttttgagagcttcgtattcaacagcacagcttccgcccctaataagaagcaggcgtgaacggcataaaccatttccggtctgttagaaagcaaaatcgcggccctgtctccttttttaagcgagcagtatttggacagccgcgcggccatttgtttagaagcatgatataattctctgaatgtcatctgtttgttttcaaatatgagagcgattctctccggtgtcagctgagccctttgaatgagccaattcggctgttctgtcagcatgttatcatctccgaggtaaaagtactgtttttgaaaagaaaacagcttggaccagagcggctcaagctgtttcgtagtgtcatctgatcacggaaaacgagggaattgaccgaaatcgggactgcgtttctctttaaaggaatcacggccttctttcgcttcgtcagtcgtgtaataaagaagcgttgcatctcctgcaaattgctgaattccggcgaggccgtctgtatcagcgttaaatgccgctttaaggaaacgaagggctgtagggcttttctcaagcatttcttcacaccatttaattgtttcctcttcaagtttctctaatgggacaaccgtattgacaagccccatgtcgagcgcttcctgcgcgttgtattgacggcacaggtaccagatttcacgggctttcttatgtccgacgatacgcgccaggtaacctgagccgtaaccggcatcaaagctacccactttcgggccggtttgaccgaaaatcgcgttatcggccgcaatcgttaaatcacagacgatatgaagcacatggcctccgccgatggcatagcctgataccatcgctacgaccggtttaggaatcacacggatcaaacgctgaagatcaagcacattcagacgcgggatttgatcgtctccgacatatccgccgtgaccgcggactttttggtctccgcctgaacagaatgctttatctcccgctcccgcaagaacgatgacaccaatattggagtcatcacgcgcacaagcaaacgcgtcaatcatttctgataccgtcttaggagtaaatgcgttatgtacctccgggcggttaattgttatttttgcaataccgttatacgtctcgtacaggatttcatcgtactgacgttcacttttccattctgcagccattgatatgacctccttcatttttgcctgagtccggccgaaaagctattttctttatgctttacaagccgtataaaaactcacttactatcttaccaaaaattcgcggctgttccacatgtaccgtgtgccccgcctgtttgacaacctctattttacttgatgggagcaggttatgcaccttttgattaatagcgcaaaacttttcatcccattcaccgcatatgagcaggacgggcgccttgatgcggtgtaatgcctcccaccaggaaggctgtgagcctgtccccattccgagcaggcttcctgcaagtccggacggattattcttcagcctgccggcacggatggacgcctttacgctgtccggaagagaaagctgcgtggcaaacaacggaatgctctcccaataatcaacaaacgatgttacaccttcccgcaatataaagtcagcaagcttccggtctgactgaatccgttttttgcgttcctgaagcgtgctgaggcccggggttgtactttccaaaacaagcgctgacacccgatgcggaaatgcctgtgcaaaggaatacgcaagtcttccccccatagaataaccaataagtttcactttgtgaagttttaattgatcaaaaacggcggcaaggtccgcaacctgccggctcgcactataccttgccgcttgcacaggcgcgtctgtctccccgtgacccaggcagtcaatcatcaccattcgctcgccgggaaacatgccgcgtaaaaacatccatgattctttgctgcccgtaaatccatgcagacaaacaatagcttcagacgattcgtgtccgtgtccgctatcagcagcacgatagcatacgccgtcggccgttttaactgttacagtttccattcttttttcacttcccgcactgcggcctgcagcagatcgcgatggaattgaactcttgatgtccgatctgttttcagctcgattatatgaagtccgggcttgtccgcctgcggctgatacgcatccttaaatgcttcccatgtctcaggacaagtatacgtcccgccatacagtgcggcggcatgccggaaatcaagacccgtcggcgtaccgaacagttcttcaaaatgagtcttatcagatgcctgcggcaaaaacgagaaaatcccgccgccatcattgtttattaaaataaccgtaagcggaattccaagttttttagccgctaacagcccgtttaaatcatgataaaacgataaatctccaatgacaagcgtgacaggagcttttgtaccttcacacagtcccatagccgaggagacaactccgtcaatgccgttagcgccgcggttggcatagacacggaaggaacgatcttgtttttcaaagaaagtatccacgtcgcggatcggcatgctgttgccgacaaaaatcgaactgccttcagggacaaggtgctgaagctgacgatatacatttccttcaaatgataaatcatccatgctcgcggcctgtaaatgactccggaaccggtcattgacaaattgccatttctcaagccatccggacggccgttttccggtttcagctgaacggaccgcttccaaaaacacagacggatggcaatgaatcatatgcgcgccggcctgggtgggatctctccatcctccgtcttcatcgacgataaactgctcaatggcaggatcgtctctgagccataaaaagagcggtttggaaaccggcatcggaccgaagcggatcacagcgtcagggcgcagcgcctcttttatttcttcatcttttaagaacgagtcataagcatcaataatcagcgtcttatcatgctccccgtttcggaggtttgaaagcggatcagccaaaatcgggaactgaagcatctcggcaagcgcgatgatttgctgcttttctgcttcaccgtgaatttcgccgcagacgatcatacctctttcggtacccgcgagacgctctgtaatatgacagagagagtcttgatcagctgactgaatccctgttgtgactgagacgtgcttcccctttctcattctttcaaaaggtccggctgataaatccggcatcaaaggctctctgagcggcacattgatatggactggccccatcgggcgcttcccggcttcacttacggatctgccggccaatgttctgatatagctaagcatttgaggtttttcctcaggaagagctgagtctgtgaaaaacttaacaaagttaccgaacagaaaatgctggttaatcgcctgaggcgcccccacttccctcaattcatgaggccggtcagcagtcaggacaataagaggcactcttgaataatgagcttcaatcacggccggatagaagttagccgctgccgttcctgacgtacaaatcagcatgaccggacgctggcgggcttttgcaagaccgagtgcgaaaaaacctgcggatcgttcatcaatctgtatatggacttgaatatccgggtgggccgccgccaaaaccgccaggggagttgacctcgatcccgggcaaacaaccgcgtcggtgacacccgatagcgcgaattcatcaataaagcttccgatataatgtgtaatcgggtttgtcaaagcctttcacctcctaaagcagagatcatcggctttagtttaatttgtgtttcttcatattctgattgcggatctgaatcttcaacaatgccgcagcctgcgaaaagccgcgcacttttgccttcaatcagccctgatcggatagccacgacaaattctccgttttccctgccgtccatccagccgatcggagccgcataccatccgcgtgtcatcggttcaatatcagcgataacttcaacagctttctgctgaggagctcctcccaatgccggagtgggatgcagcttttcaattaaatcaaacagcgaagcggacgttttcagattgcctgtgatcggcgtatatagatgctgaacactttttgttttatataattgcgggcctgcaggctttttcacatcactgcagctcgacaagaaagaatcgtgtatcatcttaaccacaaaatcatgttccgcgagatttttttcgtcatgcagcagctctttgccgagacggtcatcttcttgttgattttctccgcgcttaattgaacctgccagacaggtggacataacgtctttgcctgattttttgatcagccgttccggtgaagcgccgacaaagcatttatctccctgctcaatcgcaaaaacatagcttgtcgtttggtccgtcaaaagcttgcggacaacgctctccgccggaataggcccatcatatgacaaaacgacttcccttgccagcacgactttatcatattgatttgccttcatatcatttgttgctgttttaatggcttcaagccagttttccacatcaagttcttccgcttttgttaaaacaggatattcttcatactcaattgaagaaactgcaaaagcttctgaaaaagatttcagacgtttcagcgtatcttctgcctgattaccgtctgccgcccattgattgacggttaaataatcgccgtctgccgtctttgtcagcatgagtgaggggataaagaacattccttcttcaaacccgttccattcgtctcctctctcttcagcgggattaaatgaaaaaccgccgaataagacagggccgaccgcggtatgcgccgcctcttcttcttcatgaatatgaaaagccgtctttttaaagcgctcccattgttcaaaaacgtcgtgataacgttttccatttttttcattcgattggaacagcgcttctgtgccaagaccgactattgttaattcactaccgggttctgaccaaaaaaatcgtttgcctttatatttttttgctccgtctttgaaaaatgatagagggtctaaagacgcaatacgtcttgaatagctcaataagacagcatggttgacttgtttggctttatgtaatgcatgatctgcttcctctcggaacgtatgctgcaccgttgtcaccatgagacattcctccataatccgttaaatgcttttaatacaatacacctgtgatgaatttgtgtcaaacacacagatttgagcacgacaaaatgcctgcatttcttattataaacctttttgcgcaaatgaataaagaaacaaacttgaattttctttccccactctcggcaatcactgtatccttttacttcctcgtgggaaaatgactatttttatccaccatttttctgcgtaaaaacgttcatactaacagtaagcatcacatagaaacgagggattgatgtgcttacaaacgaacagatcacacacttaaaaaaagaattggaagaagccagagatgatattttaagccgctttaaagaaaatgatcaatttcagttaactgatgaattcccgtatcaatcatccggcgaattgtcttcctatgacaatcatcccggcgatcaggcgaccgaattatacgagcgggaaaaagacctggctctgctcgaccatgaaagggagcaccttcgcgatattgattactctctgaaacaaattgaaaacggcacatacggcacatgtgaagtcagcggcaaggacattccttatgacagacttgaagctctgccgacggctacgacattggcggaatattcctcgcaggatgccgtttccaaagacaggccgattgaagaggaaacaccgttcggacagtttgaatttgatgatgatgaatcaatccgggcggcttacgatagtgaagatgcttatcaggatgttgagggatacggaaactcagaaacgcctcaggatttagaagatccgccgctcagctatggggatatgacaatgaactcagaagaaaacatcggctatgctgaggattatgaaaactttatcgcgacagatattaccggaaaaaacatttccgtgtatccaagcaaggcacacgaaaaatatgagcaggaactggacgaagaaggaattatgacgacctttggcgaccttcatgctgattaaaaccccggcaggccggggtttttgaatacaaataattggtttgctgcattttcacaccgaaaactcatacacttaatggtgcatgaaccttttgaacggtttaatctttccaagaaagggaactaacgtattgacattgaatgacggagggaacaaatgaaaaagaagtatatcggtgcgattattgtatttatcattacatatgtcttgttttctttagcagggtttctctttcccatcgaccgggaatggtacgacgcgctgcaaaaacctgactggacgctgggcggatcagtgatcggcatcatatgggcggttttgtttgcgcttatttcgctctcagcagccttaatatatgcaaagttttcatgtaaagaatccaaagctttttgggtgatgcttctcatcaattatatcgtgaatcaaggattcagctattttcaattcacacagaaaaatttgcttgctgcatctatcgattgcctgcttgtggctgtgacaacactcattctgttgctcattgccggtaaatacagtaaagcttcagcctggcttctggttccttatttattatggagcgcttttgccacatacctgtcttttaccatttacgctatgaacgcataataaaaaaccttgcatactatgcaaggtttttttaatgacccgtacgggattcgaacccgtgttaccgccgtgaaagggcggtgtcttaaccgcttgaccaacgggccttatggcggagaaggagggatttgaaccctcgcgccgcttacacgacctacacccttagcaggggcgcctcttcagccacttgagtacttctccgtatggctccacaggcaggattcgaacctgcgaccgatcggttaacagccgatagctctaccactgagctactgtggaaaaatcatcatggtgggcctgagtggactcgaaccaccgacctcacgcttatcaggcgtgcgctctaaccagctgagctacaggcccatgacaatataaaaatggagcgggtgatgggaatcgaacccacgacatcagcttggaaggctgaggttttaccactaaactacacccgcatgttgtttggggcgattgatgggaatcgaacccacgagtgccagagccacaatctggtgcgttaaccacttcgccacaaccgccaaaacaatattaaattaaatggtggctcgggacggaatcgaaccgccgacacacggattttcagtccgttgctctaccaactgagctaccgagcctttttataaatggcggtccggacgggactcgaacccgcgacctcctgcgtgacaggcaggcattctaaccaactgaactaccggaccattttttggttgcgggggcaggatttgaacctgcgaccttcgggttatgagcccgacgagctaccgaactgctccaccccgcgatgataattaaattagatatggcggaggaagagggattcgaacccccgcgggctttgacacccctgtcggttttcaagaccgatcccttcagccagacttgggtattcctccgtataagtggtggaccttgtaggactcgaacctacgaccggacggttatgagccgtctgctctaaccaactgagctaaaggtccaatggtagcggcggaggggatcgaacccccgacctcacgggtatgaaccgtacgctctagccagctgagctacaccgccaaaaacaattaaaatcaagtggagcctagcgggatcgaaccgctgacctcctgcgtgcaaagcaggcgctctcccagctgagctaaggccccaaagtggtcgggaagacaggattcgaacctgcgaccccatggtcccaaaccatgtgctctaccaagctgagctacttcccgtttttcaaaagtatgtatggcgcgcccgagaggagtcgaacccctaaccttttgatccgtagtcaaacgctctatccaattgagctacgggcgcaacaataagtgccgagggccggacttgaaccggcacggtagtcacctaccgcaggattttaagtcctgtgtgtctgccaattccaccaccccggcatggatggtatagtatagttggagcggaagacgggattcgaacccgcgacccccaccttggcaaggtgatgttctaccactgaactacttccgcgtttggcaatgcggatgaagggacttgaacccccacgtctgtaaagacactagagcctgattctagcgcgtctgccaattccgccacatccgcaagaaaaacatggtgagccatgaaggactcgaaccttcgaccctctgattaaaagtcagatgctctaccaactgagctaatggctcttattacaagagacttatatagtataacatataaaagtggtgccggcaagaggacttgaacccccaacctactgattacaagtcagttgctctaccaattgagctacaccggcctaatacgccaacttatgtatgattggaatggtggaggatgacgggctcgaaccgccgaccctctgcttgtaaggcagatgctctcccagctgagctaatcctccgtatattacacttacgtgtaatggcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaatggaacacagactaagttcactgcatcctgcagtaacgtctgtgtgatctgcatcgtgcagaccttagtttgactgactacgcacatcactgtgcgatttatttaaaactttgaattaacaggtacgttttgtcttgtttagttttcaaagatcatgaccgcttattgaagcagctttattatcttaccacccagcttcttttatgtcaataactttttttaagttgtttccgaagcttttcgttgttgtctgctgttcatcagcgacgtttaataatataacacccttttgaaaatatgacaatagttttttaaaaaaaatcattaattattttctttcatacttatttcagtttctcttctatagaaagataagctgtcttgtggtttggtatattttcttgtatagtaagattgaactaaatacttgatgaccacaaggggagcattaaagctgagagtgaacgttttgttctgaccctttgaacctgttagttaacgctggcgtagggatgtggcaaagccaaatgatttgcagtttatgtaagcagcgcgcggaccttttcccatccttccccgcgctgcttttttgtttatccttgatacggttgtctgaccagggggaaaactatgaatcattcaacacagcttgtgcgcttaattgaaatagcgattatgaccggggcggctgtcattctggacattgtctcaggcatgtttctccggatgccccaagggggttcggtctctattatgatgattccgatttttttgatttcattccgctggggagtgaaggccgggcttacgacaggctttttaacagggattgtccagatcgccatcggcaatttgtttttgcagcacccggtgcagctatttcttgattatatcgcggcatttgcagttctcggtttcagcggcttgctcgcttccggtgtacgagcatcggcattgaataaaaaaagaggcgctttaacgatgtatgttataggcggtgttttcaccggcagtgtgctgcggtatgcggcgcatgtggtctccggagcagtctttttcggaagctatgctccgaagggtacgccggtctggatttattcatccgtctataacgcgacttacatgattccttcttttatcctttcggccattgtccttatcttattattcatgactgcgccgcggcttcttgaagctaagcggacgaactgaaacagcaggcggtttacgcctgctgtttttttattccgggctgtgccgttcgttagaatcactcagttcttttgtaagttcatttatgctttgttttatgtttcctttgcctgaaaaattctcaatcagctcttttacattgattccggaagatgcttttaagctttcctggagaccggccattaaattggttgcgtagcctgtgactttattggccccgccgttttcaccgcttcctcccgtatccacgacggtaattttatcaatgtttgaaagaggcgctgagacttgttttgcgtattcaggcagcattttcacaatcatatcaaggattgcagcctgcccgtatttttcgaatgcgtcggcgattttttctttagcttccgcttctgcgagacctttcaggcggatgacttccgcttcggtttctcctctcgccttttcagcctccgctttagcaagaccgtcaattctcacgcgttccgcttccgccttggccatcgcttcgatgctgtactgctcggcatcggcttcggcgagctgcttcgcttttgcggccgcggccgcttgttccaccgagtaacggtcagcatcggcttttttcttcacttcagagtcatattggcgctcacggcgcagaatttctttttcctccaattcaatctgcttttgccgctcaataattttaatttgcatttcctgctctgtcacctgctggcgcgcttttgcggtttcaagatcatatgcctggtcggcattggcttttgctgtatcctgctctcttctgtattccgccattttcagctgattgattttttccgcttcagctatttccgtcgcccgctccagctctgatttttttgcgtctttatcagcggccgcgcgtttaatcctcgtctctttatccgcttctgccgtggcaatgtccgcatcccgcttgacttgggcgattctcggcttgcctaatgattcaagatagccgtttttatcccggacgtctttaatcgtaaaagaaacgatcatcagccccattttagcaagatcctgagacgcgacccgctggacttcctgagaaaacttttccctgtttttataaatctcttcaacggtcatggagccgaggatggagcgcagatggccttccagcacctcccgcgcctcctgctcacggtcgtccttggatttccccaaaaattgttcagctgctgtggcgatttcaccgatggagcctccgattttaataatggcggttccgtcggccattaccggcaccccttgctctgtatagacttcaggtgtagagacatcaagtttgcttgacagtaaactgagaggttctgcctgctggaataccgggagcacgaacgttcccccgccccggacgattttcagacgatttccgccttcatcaatgtggacgttcttatttcccaaataacttccggtcacgataagggcttcgtccggccccgctgtccggtacttcgtaataaatacagcaataagtgcgatgagtaaaaagaatacgattccgataacaatgataatcggcatagtcataacagttcccccttagatatcagattggttcatgcggcgtcacaaaaagcactccgtctttcacgtcaatcactaatacggccgttccgtatctgatctgttcttgatcaaagctgacggctgatttagaaatggcgccccctattccctctatgatcacttccccatagccgtctttcgggacggaagtaatgaccctgccgaccctgccctttaaatctgtctcccgatatgcgagcgattcttccgctgatgaaagcggggcaaggacgaagaagtgaagcaggctgaccaaaagaaccgaaagaacaaatgaaagcaacgcaatgacaggacttgatagcggagcggcgatttcgccgatataacctgaggctgaaaagattgttaaaaaagacagaatcaatgcagggtttaaaaatgaaacaggaatggcttctgagaggccgtgaaacacatcttgaaaaaacagaatcaaaagcgtgagacttcccgaaataatcaatgtgtaaagatagaccgtttcaaacggcagatgaaatatgtccacattctatcctcctttcggctgaggtgtcggagtgttactttatatacggatgtaaaggtaaatggtttcaattttctgataaggaaggctgattacatgattatccaatccggatatgatatgtttactctaaaggaggagataggatgagcatttttaatgaagccagacagcagacctgggaagtactgaaagggctctctgatgaggaattcaaccgaaagcccgcggctgatgagtggagcgtgcgggaagtccttgaccatttaaagaaaattgacgaaacagcgcagacccttttatcaaagcaggcaaaagacgcaccgtttaaaaaaatcgaagacaaaccgatggagtttatagaggacagatcaaataaacggccggcgccgtcacacctcgaacctgagcaaaaccgaatctcagtcattgaagcaaaacaagaattagatacggcaagacagcagctgaccgcagttatttcatcattaaacgaggaagattttgaacgtgtgcttccgcatcccgtttttcaagaactgacgatccggcagtggattgattttatcggccatcatgaaaagcgtcacatcgatcaaatagaagaaatcaaacaaaaaatcgagaaggtctgagtcagaccttctcgatttttttcttggcgcgtttcggttcataggaatggatggtgaccgcatcgcccgtgcatatatcacccgggcgttcaacaatacagacaattcctcttctgcccatcgcgtgcctcacaaacgccgcggcgagttttggctgagccggataaaaggattgaatgacttctcccggctgaatgcacggatcattttctccctcgcacaacagagacgcaccgcttggaaaaatcattctgcttccttctttaagcggcgtcagcgcagaaaaaccgctgattgcgatgttagcgccgagccattcgggaaagatatgagaaatccccatcttctccgcaatgtcatcacattcctccatggacacgattgaaatttgtctccggttaaaaatttctgttcctctttcatacatcggctcacgcgcgccggccttttttgtcagtccgaaatgcaggtcaccgggaaacccgccgtattccgcgcgaagcttgtccatctttttggtaacaaattgttcggtatccgctatatatacgccttccgtctttgctgttatgcgtttccacatcagccaccaccgcctttttcttgacattatccttaaaaaaccccgctctgtaaaggagcggggttcatttattataccgttttcggcgttaagtcaaagcagcgtttgtaaatccagttgtatgctttctcattcaaatctcttggatttccgaaagtctgcggatctttcatggcttcttttgataaacgttcaatcatgtccggagacacaccttgttcttctaaactcggcacttctaaatcttttacaagatcatacatccagttgacggacgctttggccgcttcttcggttgtcatgttgcttgtatcgattccgaatgctttggcgatgcgggcgaatttttccggatagcctttccagttgtattccattaccggtcccatcatagctgcgacgcattgtccgtgagcgacagggatgatgccgccgagcgtctggctcatcgcatgcgccgcgcctgctgattcactgccgtatgaaaggccggcaagcatcgccgcctgcgccatgccgtatcttgcttccaaatcctctccgtccgcaaacgcgcgcttaatataatgcgccgcatattcaatggccattaaagcgacggcatcagtgatcggctgcgcgaatttcatcgtatagcactcgatggcgtgcgcaagtgcgtcaatacctgtcatggccgtcacatgcggaggcatggacgtgtgcagctcagggtcaatgaccgttaaatgcgcagcgataagcggtccgcccgtattgaatttaaattctctttcctcatctgtaatgaccgcccattgtgtgacctctgaacctgttcccgcagtcgtcgggatcgttgtcagcggaggaatgcggttttccagcggctttttgccttccgcggcttcataatcaagcacgcttccttcgtgtgtcgcttctaccccgatcgctttcgccgtatccatggagcttccgccgccgacagccacaagaccgttgcagttttcttttttatacagttctgatccttcgtttacaagacgtacaggcgggttcggctccactttgttaaacaggacgacttcgatgcccgcttcctgcaaagattcaatgaccgggtttgccactcccgcgttataaattcccgggtctgttacgagcagcgcttttgtgacgccaagcgctctgacttcacttcccgcgtgctgaatcgcgccgattccgtgtttaatgactgtcgggatttcgaatgtatggaatttatgcatgctttctactttcatatttaatgtcatattgtatctcctcctaattatgcttgaaaccagttcacagccgcaggtttcgtattgcggtaaatatgtttgatttccgtgtattcttccaggccgattttgccgagttcacggccgaagcccgattgtttgtacccgccccatggcgcttgcgcgaaatacgggtggaaatcattgatccataccgttcccatccgcagtttggcggctacgcgttcgcatttttcaatatcctttgaccataccgctccggccagcccgtaaatggtatcgttggcaagtctgatcacttcttcttctgaagagaatgactcgactgttaaaacggggccgaagatttcctcttggactattcgcatatcagacttgcagtttgagaaaatagtaggttcatagaagaaaccgttttgaagggcgggatcatcaggacgtttgccgcctgtttccagttttgccccttcttcgataccgatttctacgtatttttcgactttggcccgatgctcggcggaaatcagcggaccgctttccgtatcttcatgaaaaccgtttcctaatttgatgcgtttcgtgcgcttgatcagctcggctaaaaattcatcatgaatggcttcgtccaccaaaagacgtgacccggccgaacaaacttgaccggcatggaaaaacacggcgttcagcgcttgatctgcagctgtttcgagatctgcatcttgaaatacgatattcggatttttgccgccaagctccagggcaatctttttcacgttgccgcttgccgcctgcatgatttttttgcctgtttcaattccgcccgtaaaagagaccaaatcgacgtcgaggtttctcgccagctcatcgccgacagaggcgcccggccccagcacgagattggcggcccctttcggaataccggcttcttctattaattgaaagactttaatggttgtaagcggagtaatctcgctcggctttaaaacgatcgtgtttccagccgcaagagcgggagcgattttccagctcgcctgaaggagcggatagttccacggcgtaatttgtccgcatacgccaattggctctctgacgattttacttactgaatcgggaatcggagatgaaatgacttcgcctccgtctttatccgccaaaccggcataatattgaaatacatttgcgatatcatccatatcggctttactttcttcaatcgtttttcctgtatcaagcgattccagctcagctaattcgttcagatcgcgtctgattaattccgcaattttcagaacaaattgtccgcgctcgagcccggaaagcaccggccattccccttcatcaaatgcttttctggctgcggcgatggctttcaccgcatcatcccggtctccttcgcataccgttgcaatttcttcttgattaaatggattaatgatacggcgggtctgttttttttctgcactgatccattcgccgccgatataaagcgttttgctcataagagtcctccttaccgagaagtaagtttgttaaataaaaatttaatgtttttaacaatgttaatttaacacatgtttttttgcctgtcaaaacccggtcagtccgtttagattttgacattttgtcatgattcgttaagattaagaacataaagaaatgacttaacaaatttaaacttcaagaggaaaagagggacagtatggatgagaatccagaattcgcagctatagaacaagccagggatcttgtcattgattccattgcagagacgatggatctttacggaatcacccggagtgtcgggattttatacggaacaatgtatatgagggatgaaatgacgcttgacgaaatgcgtgaggaactgcagatgagcaaaccgagtatgagcacgggcgttaaaaagctgcaggatttaaatgtggtcaaaaaaacctttcaccgcggcacacggaagcatacgtttgtagcggaaaaggatttctttacgtttttcacgaatttctttccgccgaaatgggaccgtgaagttcaggtgaatttgtccgccatcgtacaggctcaggcggatttgcagtccgttttgctggccgaggaaggcagcgcggaattacaggaagaagcgcggcagttatatgatcagcttgaaagctcgaaagcttattatcattggctgaagcggctcgccgactcggttcagagcggggagatttttaaatttattccgatagaaacggacgaaaaaaacgcctgattttgattcaggcgttttttgtcgtgatttgattatttttgagaaaatataggaacataaccccatttacttccattaaaattgatggtaaatttttataggtatggtcgttcttttttaagaacaatcagcaaattttttttagggggatttataaaaatgaaacacaagtttttctcaactgtcatggcaagtttattcggcctggttttgcttctttctctgccgacagcgtcattcgccgctgagtcaggctcaaccgttcacgagccggaaatgtccacgaaagcgactgctaccttatttgcaaaatatacaggtgccagccagcaggaatggtcattttctgatatcgaattgacgtaccgtccgaacacgatcctgagcttaggcgttatggaatttacccttcctagcggatttgcggctacaacaaaagatacagtcaacggacacgctttgcgcgaaagacagattctgaataacggcaaaacagtcagacttccgttaaacattgatttgctcggcgcagcggaatttaagctttctcttaataataaaacattgcctgctgcaggtacatataagttccgtgcagaaaataaatcattaagcatcggctctaaattctatgctgaggacacaattgttgttcaaaaacgcagcacaccgccgacacagccatgcaactgcaaataattgcgaaaaacggaccggcacaagctcatcgcttgtcagccggtctttttttgtgctgttttctttcttccggccctcgcattgacaaacccctgaaacaggagtacattcttgtttgttgtatttggagtgacgaaaacagtttcttaaggagttatgaggattgggaaaaatcaaaaataaacaatttgccgtcatcggactcggccgtttcggcggaagcatctgtaaagagctttttaaaatggggcatgaggtgcttgcgatcgatatcagcgaagagcgggtcaacgcatactcctcttatgccacgcatgccgtgcgggcaaattcaacggaagaaagcgagcttcagtcgctcggcatcagaaattttgaatatgtcatcgtagcaatcggagccaatatacaggcaagcacgctgacgacgctgttattgaaggagctgaacatccctaatatttgggtgaaagcgcaaaactattatcatcacaaagtgcttgaaaagatcggtgctgatcgtattatccatcctgaaaaggatatgggcgtgcggattgcgcaaagcctttcagatgaaaacgtcttaaattacatcgatttgtcagatgaatacagcattgtggagctttcagccactaaaaagctgcatttaaaatcccttcttgatctcggcgcacgcgccagattcggctgcaccattctcgccgtgaaacataatggagacattcagctgtccccttctccggagactgtcattcatgaatgtgactgccttgtgctgatggggcataaacgtgatattaaaaggtttgaaactgaaggaatgtaaaaaaagccggcaagctgccggctttttttgatgcttatgtttcttcacttaactggacggcggtttggtcaacccagccgaccagcttatctttcacttgaatttggtaccagacggattctccgttttgtttttcagatacgactttaatatgctggccggtaaacttttgcgccgatgccagtttaatagaatgccgctctttcgacggcttggaccacacgtcttcaatggcgtggtctttgatggcgcctttcttatcaactgctttaagagaggcattgattttgtcatattcattcaggttataggtttctatgacatctttaattttttcagcatagccggggtctgtggcgtagccggatttttgaagggcagccgccgctgttttataattgtccgcttcaatgacgggcttgtacttctttttattccaagacgttccgttgacaaataatttggcatggtcatccattgattcaaaaaacgtgctgtatttacggaattttgcccgaatcgtttttcgttttcctttttcaaattcatccgttttcatcgtgacgtgttttcctttataatcaccttttacaccgaacaggttgcgcgctttccccgcaagctcactgttcccccagtccgattcgagaatggcctgtgcgagggtgatgctcggaaggacatgatatttctcatataaaatttgagcatgcccggaaaggctgtcaataaagacctgctgctcgtccacctcttcaggcggtttttcttccgtcactatgaatttcgaaaataccattgataccagaaataatccgaatataagagatacagcaaaaaggcacccaagcacccttttggtctttgctttctttttcatatcaaccttcctttaattccggaatcactagatttataattttactggtcattgatgaaaatttcaataaaatagggaaaaagacggagaaagaacacatcgtgcaaataaaaaagactcctcaatgaggagtctttttttgttatgccatgctcagctgagggccgaacaattcaaattgaacggaatcagagtcaaacccgagtgcaagaatcatatctttcatttgcgtcataaactgtgctgatccgcacaagtaacattcagcatcttgattcagatgaagctgctccaagaaggtttgatcaatccggccgctgtaaaaaggcttgtctcctgagcggtcttgttctgccggttcactgtatacataaatgacgttaatattcggatgattctccgcagcttgttcagcctctttgcggaacgcggcgtactctccgtttttcgcggcatgaataaaagtaacggaacgctcgggctgtttttcggcggctgttttcagcatgctcatcatcggcgtgattccggaaccggcactgataagaacaaccggtttttcggaagaagacagcttgaaatccccggcgggtgcactgacttcaagtttatctccctcttgaacttcattgtggagatgagaagaaaccgctccgtcctttttcacagatatccgatatgcgccttttcgagaagcatcagacaggctgtactggcgaatgtgcgtataaggagaatccgcaatcctcactttaatgctgatatattgtcccgcttcaaatccaggaagcgaagagccgtcactcggtttgatataaaatgatgtgatatctttgctttcttttgttttctgtataaccgtaaattctttatacccctgccatccggcttcactgtacatgtctttttcaatgccgataaaagcctccgcaataacaccgtaagctttttcccatgcctgcataatttcaggagttgcggcatcctgcagcacatccttaatcgccagaagcagatactttccgacaatcggataatgttccggttttacaccgatacttgtgtgtttatggccgatctgtctgaccgccggaatgatttgttctaattgatcaatattcgccgcagccgcaataactgcatttgccaatgctgcgcgctgagtctgtttcttttggttcgtttggttaaacatatttaacagttcgggatgatcttgaaacatcaggttataaaagcgtccggtgatgttttctccatgtgtttttaatacgggtactgtgcttttgatgatgtctactgttctctcatccagcatgttcatcctcaacccttctaaagatgtatttttaatatatctttatagtaagagatatttcgaataaaagatatatctaaaatgaatctttaaaaaagtcgtcacaatattgtgttgaatttggaatttatggattttacctccttttttatcacccggtgaaacagggacacatatatttgggaatatacgtttaaagatgaaagcgggggattgcatggtttccgatatcgattacacgtctccgaatacacagttcacttatgatgtaaatgagagccgtttttttacgaaagatgctcggaactttatcaatgtattggggattaaacagttaaacacgcttgaaaatatttcattattagatatctttctgagtaaaacaaatgtgattgaaccgcatacccatcaaaacgccgctgaattggtgtactgtatttcgggttccgcggtggtgtcgatgctgaatccgttcacccagaaaatacggaattatccgatctctccaggacaagtggcgaatgttccgcaggggtggtggcattatgaagtcgccacttcagacaaaacccaccttttggccatatttgacgccccttcgcctgaagtgatatatggctcggatattctccgtctgacgccgcctgagatcatggcgcatacgtactgtctgaatgagcacgagtgggaaaaagccgtttcaccgatccggcaatcaactgtgataggtcccgataaatactgcggacagtctgaaaacacgggtattcatgatatgaataagccttatcagccaaatacgcattatccgaatgatccgtatcggcattatgttcagccgttctatagggggtattaagcggatccacatcgacagaaagagcccctcattgcagaggggctcttgatcattacgatccggttccgcagcttactttgtactcgccttcggacgatttttttgaataacatacgtgcggcgtctgtccggtttcatctttccaattgaaccaatttacataataaaggttcccgtcctctccgcctccttcttctttttgaagaatcgcaaagtagctttgatacggatatccttttttataaatgtcatgcctgatggctcctttttctgaagcagacgtgaagatgacaggagaaagagccgggagcgccgttaaaagaagtgccagtgcagctgacagagataatataagatagattttctttttcattttctctctttcctttattttgagttgttagaaatgaagcggaacacagaggctgctgcagaggatgaaaaaacaaaaaaacccttatttatagaataagggtttaaaggtatggagccaagggggctcgaacccctgacctctacgctgccagcgtagcgctctcccagctgagctatggccccgtgctgtaacgtcatgttttattatagacgactcttctatgaatttcaagcagaaaattcagtttgctcatattttcctgagacgtttttcgaacataaaaagaagaccctccgggggcctcttcgtttatcgcacgagcatgattaaaatgatgccgaggatgacacggtaaatggcgaacgggacaagcttaatccggttaatgagccgaagaaaaaacttgacgactaagagggcgacgacaaaggcgcagataaagccgacaagaaaaaacggaatcatgtcataagaaagactgctccagtatttcaccagcttcagaaggcttgcgcccgccataatcggaatcgccataataaatgtgaagtctgcggctgcccggtgattcaagcccacaataacacctccggcaatcgttgagcctgatcgggaaaatccgggccataaggcgagacactggaataatccgacacagaaagcctgtttgtaggtgattctgtccaccgtatcgatcgtttctttccttttattgatccagtccgctataagcataagcacggctccggcaattaatccgtaagcgaccgttctgacggagaataaatagcggtcaatgaaatcctcaaataaaaagccgagcaccgccgctggaacaagaccgacggcgatttgcgcgatggtcagcctgtatcccttctgctgatcgcgcgtgacgttttttttgaggccgagtaaatgtaatatccgatccttaaacacaatggccaccgccagaatcgaaccgagctgaatcaccactttgaaggaattggcggcttccggattcatcaggcttccggatttcagccagatgtcatccgctatgatcatatgtcccgtggaagaaaccggcgcgtactccgtcagcccttccacgattcccaaaacggctgctgtgaacatctcccatagtgtcatcccattcttcccttcattcatcatttacaaaagagaagctctcctttgaaggaaagcctgtcttataataaatatcatgtccgttccgattttatgacttcgatacagcatcatttttttcttcttcatataaatgcgaacgcattttgaaccaatcaaacagatgggtcgtgaccactttgatgaccgcataccccgggatggctaaaataatgccgacaaccccgaacagctttccggcggttaaaagaacaaagatgatggtaatcgggtgaatgtgaagatttttccccatgatctgcggcgaaattaatttcccttccacgagctggacaacggtccagacaatcgcaagcttcagcagcataaagggcgaagtgaccaacgcgataataatcgccggcgtgatagcaatggtcggccctaaatacggaacaacgctcgtacaagcggcaatgaccgcaagcagtgacgcataatcaagtccgataatcagatagccgataaataataaaaacccgatgcagaagctgacgatgacctgtcctctgatataggagcttaatctgtggttcatttcactcagcatcgtatacgtttgttctttcagacgggtgggcacaaactttaagatatagatcggcagttttttgccgtctttcagcaaatagaacagaataaacggcacggtcacaattgaaataatcacttcagtcagcgcgccgataaaattcccgactccggtaaatgtgctgtttgcaattgtcgccgcctgcgccgatactttattggcaagatccgaaatgttgatattcatcgtcttttgcgcctgatttacaaaatcgcttccgatcaggcttttcgtctgatcttcaacgatgtccacatatttcggcaggttgtcgatcaggctcatgatctgttcctttaaaaacggaataattgaaacgaccgtaatcgaaatcagccctataataatgaggtaaaggagcaggatggaatagactcttttcactcttattttttccaatatatctacgatcggattaagcagataataaacaattcctgtcaaaatgacggggagcgcaatcgttttgagcaggacgataatgggtgtgaaaataaatgatgtcttcataaagacaaggatattgagaccgatgagcagcaatacaagcaaaaacaagacaaatttattgtctaagaaaaactgtttaaatctgccgccccatgtttgcaatgtttccactattgttcctccatcatatgtattttacttaaattgtacactatcgttcctgtaatgaaaaataataaccggtctctatgggaatttttcctatccgtttagctggcagccttttttccatttatgtttctttgaaaaaaagctataatgtaagccaatacatagaaggagcgatagcaatgattcgatttgcaacagtcggaacgaattggattacagaacgatttctggaggcggcttctgctattgatgattttcaattaacggcggtttattccagaactgaggaacgtgcggcggaattcgccggcaaacacggcgctgctcattatttcaccagcctgaaagaaatggcggaaagcaaagcctatgacgcggtgtatctcgccagcccgaatgcatttcacaaagagcaggcggtcctttttatggaacacggcaagcatgtactatgcgaaaaaccgtttgcgtctaacgcaagggaaacggatgaaatgattcacgcagccaaaacgaacggcgttctcttgatggaagccatgaaaacgacgttcctgccgaacttcagcatgcttcaaaaccacttacataaaatcggacccgtcaggagattcacggcaagctactgccaatattcatcacgatatgatgcatataaaaacggtacggtgcttaacgcgtttaagcctgaattatcgaacggttcgttaatggacatcggcgtgtactgcatttatccggccgtcgtcctgttcggcaaaccgaaaaacgtcattgcgaccggtcataaactagcatccggcgttgacggcgaaggcacggtcattctgtcatacgacggatttgaagcggtgctgatgcattcgaaaatctcaaattcgtttgccccggcggaaattcagggtgaagaaggcacgatcgttctggacagcattcacggaccggaacgggcggaaatccgctatcgtgacggccggacggaagacatttcagtccctgatctgaaaccttcgatgtactacgaaacggctgaattcatcaatcttcttcgaaacggacagcgggagtcttccgaaaatacatttgaacgttctttcattacggcaaacattatggaagaagcgagaaaacaaatcggaatcgtctttcccgccgatcaaaactaaaaacatccgcccggattcgggcggatgttttttatttggacgctaacaggtcagcaaacgcttttgcatactgcggaaggtcgggcgggcggcggcttgatacaatgtggccgtcagttacgacagcttcatccagccactttgcccctgcatttgtcatgtcgtctttgatgccgggcgtgctcgttactttttttcctgcgagaattccggcagatataagcacccagcccgcatggcagatctggccgatcggctttttctgctcgttcatcgtacggatgatgtccaaaacttcgggatatcttcgcagtttgtcaggagcccagccgccaggcacgagcacggcatcatactcctgaataatcaggctcttaaaatcgtaatccgccgtcgcgggcacgccgtattttcctttgtatgaacggcccgcttcttctcctattaaatgaacgatcgcgccttcctctctcagccgatagacgggataccaaagctctaagtcttcaaaatcgtcactgacaagcgctataacttttttgccttctaatctcatcactgccactcccttcttttatattagtgtatcgcttttttcagatgaggaaaagaaacagctcgttacagctgttcttcgtcttcagactgaatcgtaaatttccgtgtgacctgttgcagttcttcagccatatgcgcaagcgtttcggcggatgaactgatttcttccatggaggccagctgctcttcagctgaggcggcgatgtcttgaatgccggcggacccttctttggcgactgaggtaatgtcctccaccgcgtttgtcacattttgcgacccggctgcaagctgctcaagcgttccgttcatatgctgcaaggcgcctgaaatctgagtcgtcatctctgagatttttttgaagctttcggccgtttgatccgtaatatcgaggccttccttcacatcttgattcaccgcttggaatacggaaagcgatgtggcgatttctttgacgatttcctgaatcagcgtttcgatttcctttgcggagccggctgattgtacggcaagcttcctcacttcttccgcaacgacggagaagccccgcccgtattcgcctgctcttgccgcttcaatggccgcgtttaaggcaagcagatttgtttgatcggcaatgccgttaataacgttcagaatgctcttaatgtcgtgcgacttcgtttccagcccttttacgacggcttccgcctgctgtacggaacgatcaattgttttcatctggccgaccgttttcgccactaattcttctccgcttccggccgtttcagaggtttggatggcggattcagtgatttccgccgatacattcgccgtctcggcaatgcccgcattcatttgggaaaggtgatcagcactttcttccaatttctcgctttgtgattcgtttccgtttgagaattgttcaatcgccagagtaatatgctctgtcgccttgcttgtctgtccggcggatgccgtcagctcttcggatgaagaagcgacatgttcgacggatgattggatgacgccgatgacagaccggagtgatgccgacatctcattgaagctttggctgagctgcccgaattcattttttgacttgatgtcaatgacttccgttaaatcgccgtcactgattttatctgatgtcgagacaagttttttgagcggttttgcaatcgagcgaatgataaagaagattaaaataccgccgacgataagagaaaccgccaggatgatcagcgccattttcatgacaggcgaggctgcgtcatggatctcactgacaaaaaatgtgccggcgattttccagcccgtcagtttgtttgtcgtgaaagccattttcttctgctgtccttcaaacatgtattcaaacgatccgcttgatttggaaaatacttctttcgtccactctccggagccttccgttcccgcttttatagtcggatgggcgatgtattttttatcccccgttgtaatgaaggcaaatcctttatgaccgatctggacgcgttcggaagcgttcagcaggtcgcccagattaatatcaagcgccacaacgcctgatccgtcttttgtctgctgggcaatcgtaacgaccgtctgtccggttgcagcgtctttataaggctcggtaaacaccggctgtccgcttttttcaaccgcctttgtataccactcgcgcgtgagcggattataatcggacggcatgtcagcggacggatatttcacaaacgctttgtcgcgagacgcggcgtaaattgacgcgacatcgccatttacggtgacatactgcttcatattgtcgagcagtaccgatttatttttcgtgttcagtttttcctttgtgattgattcgctgtagtagtcaatcgctttcagcttaccctcaagcatgttttccagcacgctgttcagttcactgacatttccctgggcgctgtgggtcagttcgctttctaatgtactccccgccgtttggtagctgaagtaggcgagtatgccgaccggaagcaccaatacggctaaaaatgccgcgatcagcggcttgctgatggatggctgtttgatccaatgtatcagttgtttcattttttcagtctccttctttgaaaagctaaatctaatatcgtcagataggacaaaagatttattaaaaaaactaaaaaaaacacccaaacagcacatttgggtgttctatgatctattaatctattttaaatcgtttcgtcatatcacgtaattcttccgccatttgggataacgtttccgaagacgaactgatttcttccattgaagccagctgttcttcggcagaggccgcgatatcctgaatgctggcggagctttcttttgcgatggacgcgatttgctcagaagctcctgaaatctgctgtgatcctgctgtcagctgttctaccgtcgcattcatattttgaatttctccggcgatctggttcgtcatttcagaaatccgtttgaagctcgtttcggtctgattcgtaatatccagtccgctctccacctctttgttgacggattggaacatgccgagagatgtattgatttcgttgacgatttctataattaagctttcgatttctttcgctgaatcggcagactggaccgcaagttttctgacctcttcggcgacgactgagaagccccggccgtattcacccgcacgcgcggcttcaattgccgcgttcagcgcaagaaggtttgtctgatcagcgattccgttaatgacaccgagaatgtttgtaatgtcttttgattttgtttcaagtccgcgcaccacttgttcagcttctttcactgaccggtcaatgacgttcatttggccgaccgtctggtggacgagctttccgcctgaattggcgacttccgctgatgtggcggaggattcggtaatgacggcagatgctttcgccatatctttaagcccgctgttcatttgataaatatgttccgccgcgctttcgatattttcactttggctttcatttccgttagaaaattgttcgatcgccagtgtgatatgttccgttgccttgcttgtctgctccgctgaagccgtcagctcttctgaggaagatgcgacgttattcacggaatcctgaatggcatggatgagagacctgagtgaagcggccatattgttaaagcttttgcccagctcgcctaattcatcttttgactgaatttcgatcgtttctgttaagtcgccttcactgatctgtttcgatgatgtcacaagctgcttgagcggttttgtgattgaacggataatcagcaccatgacgatggttccgatgacaatcgctaatacgagaacgagcagggacagatgaaggatcggcagggccgcttcatgaatttcgtccagatacatcgttccggtaatcttccagcctgtcagcccgttcgtatcataagccattttcttttcctggccgtcgtatttgtattgaaaatcaccttttttgctggtgaacaactgttcagcccactccccgtttaatactgtgcctgacgcacggttcgggtgggcgaccacttttttgtctttcgtcaggataaaagcgtagcctgattttccgatgttcactttctttgtcgttttcagaagctcatcgattttcatattgatggcgacgacccctgagccgtctttcgtctgctgaacgaccgtcacgaccatcgtattggtggaagccgtgcggtaaggatctgttacaacaactttccccttattttccacggcctttttataccagtctctttcaagcggattatatcctttaggcatctgcagatccggataccgtgtgaaatgtccttccgtgtcactcgtatagatggattccacgtctttattaatcttcatgtactctgtgaatttatcggtaatttgcgattggtttttcggcttgtaccgatcctttgtgagccagtcgctgaaatatgccgttccgtcttccttttggctgatgcttgtgttgatcatatcgttaatctgctgcacattatctaatgcgcttcccatcatctgcctgtcaagcgtacttaccgccgattgataggcgataaaagccagcgttgaaataggaagaatgagaatggccaaaaaagaaatgagcagttttcttgtaagcgatctctgcttgatgatttgcacaatttttttcatctgctatatctcctcttgcgtgtttacccttcatatcggcaattatgggtaaatatacacatccaaaaagaagaaatataacgaaacatactttttacctattgcaaaattagtcttttagacttaattaagagtttatcttaaaacgctttgtcagttcgcgtaattcttccgccattttttccagcgtgacggctgaggaactgatctcctccatggacgcaagctgctcttcagctgaagccgcgatgtcctgaatgccggccgcgctttgtctggagactgccgcgatatcctctgaagcgtttgatacttcctgagatccggcagaaagctgttccacggttgcattcatattttgcagttcaccggcaatctgacttgttttagcggaaatgtcccggaagcttttttccgtttcgtccgttaactgaagtccgcttttcacctcgtgattgacggattccagcattccgagcgaagtatgaatttctttgacgatttcatgaattaaggattcgatttctttcgctgaatcggcggattggacggcaagctttctcacttcttcggcaacaactgaaaaaccgcgtccgtattctcccgctcttgccgcttcaatggctgcatttaaagcaaggagattcgtttgatcggcaatgccgttaatgacgcgcaaaatgctggtgatgtcctgcgatttgagttcaagcccttgtacgacttgctccgctttacttacggattggtcaatggcgcccatctggccggctgttttcttgacaagccgctcaccggcgccggatatctccgccgattcaattgaagtttccgtcacaacggctgccgcttccgccagatcgctgagcccgtctttcatctcattcacttgtgctgtcgctttatcaatactctcactttggtcttccgttccattagaaaactgttcaatcgcaagggtgatatgttccgttgctttgctcgtctgctcagccgaagccgtcagctcctctgaggaagaagcgacatgttcaacagagtcctgaattccctgaataagcgaacggagtgaatctgtcatatgattaaaacttttaccgagcacgccgagctcatcttgagagctgacatcaatggtttcagtcagatctccgctgctgattttttccgctgaagctacgagacgttttaacggtttggtaattgagcggatgacaaaataaatgaaaatcatccctgcggcaacggctatcgccaatatgataacggccagagtcagaaccggtcttgccgcatccttgatttcatccacggacatggttccgctgatcttccagcccgtcgcttcattggtcacgtacgccatttttttcgctttcccgttcagcgtatattcatagtcgcctttttgcccgctgtataatgtatcaacccattttcccgataccgccgcgccggctttttcatcactgtaggcaacggcttttttatttttgctgaggataaaggcgtatccttcttttccgatgttcacttcttttgtcatcgtgatgagatcgtcgatttttatatcaatggcgacgacgcctgatccgtcttgcgccgcgcgggccatggtgacgaccatctttttgtttgagatggactcataagggtccgtgatgatggtttggcctttattctccatggcttcctgataccagcttctttcaagcggattgaaatcggccggcatatcggcatgcggataacgggtaaacgttccttccttgctgcttgaaaatatggcggacgctttatcattgctttcaataaactgtttaaacctttcttgcatttccgtttggtttttttctttaaatttagcgcttgtcgcccattcgctgaaatatgcagagctttttgtaaacattccgatccggtcatcaatcatattgtttaagatttgcacatttccttcggcgctttccatcatttgcttttcaacggatgaagccgccgaacggtaggcgccggcggccaatactgctaccggaataattaagatcagtaaaaatgaaatgataagttttttggctattgattttctggcgattttttttgctgtttttttcaattttgtaaacctctttcaatcatttactgtttatatcggccgactccctttttattacattgaaaattaagtcataaatgaaaaatagttctatgtactccctttgtatgcaagactttttatttaattatccggctgtcactataaaaaaggacgccttccacctggaaagcgtccttttttactagttgattttaaattgtttcgttaattcccgcagttcttcggccatttgcgccaaagtatcggcggatgtgctgatttcttccattgatgcaagctgttcttctgcggatgcggcaatatcctgaatgcttgctgcgctttcccgtgatacgtccgcaatatcggtcactgcggctgaaacgtgctgagagctgtctgacagctgttcaaccgtgccgttcattgattgcagtttttcggcgatgtcgttcgtcatgccgaagatattctggaagctttctttcgtgcgatccgttacggcaagtcctgattgcacttcttcattaacggatgtaaacatgtgaagcgaagtattaatttcagccgtgatttcctgaatgagtttttcaatctctttggcagaaccggcggattggacggcaagctttctcacttcttcggctactactgagaagccccgcccgtattcaccggctcttgccgcttcaatggctgcatttaatgcaagcaggtttgtctgatcggcaataccgttgatgactcttaaaatatgagtaatgtcttttgatttggcctcaaggccttttacaaccgcttccgcctgctggaccgattgattgatgagattcatctgcccgacggtttgctgcacatattcttccccggtgccggcagcttccttcgattgtttagatgcctccgtaatggatgatgatgtgcgggaaacggcggcgagtccgtcatttatatgattcagcttggctgagcttgaatcgactttttcgctttgctcttcgttcccgtttgaaaactgctcaatcgccattgtaatatgttccgtcgctttgcttgtctgagaagctgaagcggtcagctcttccgatgacgcggccacgttatcgacagagttttggatcgcgctgatcagtccgcgcaaagattctcccatttcattaaagctcgcgccgagttcgcccaattcatctttcgagcggatgtcaatggtttcagtcaagtctccgccgctgatttgtttagaagagcggacaagccgtttcagcggtgacgtaatggatctgacaatcaacagaattaaaattcccccgatgataatagatgctgcaaggacaatcatccccatcgtcagcaccggttgtgaggcatctttaatttcgttgagctccatgctcccctctattttccacccggtcagtttatttgtcgtaaacgccatttttttattttgatcatcgagcttgtatgaaataatgccgctgtctttgctgtatacctcattcagccacggcgttgaaactttatcgcccggtttgtggtctttatgcgcgacataggttttatttttggacgtgataaacacgaatcctttttgcccgattttgattccctgcatctgcttcagcagctggtcaatcgtaatatccatggccactacgcctgttccgtcctgcatctgctttgccacggtaatgaccatgctgccgtcgcttgccgcggtgtaagggtcggtgacaacgagcgtgccgccggccttcacagcgtctttataccaagtgcgtgttctcggatcgtaatcggccggagtattttccttcggcgcctgtgcgtagctgccgtcttccgttcctccgtaaatgcgggctacgtccttatgaatagacgtgtattgcccgaacttttcttcaagagcagacatgtttttctttgagaaggatgatccttttaacgtttcactgaaaaattcaatcgcctttgcttttgcgccgatatcatttgtaatcgttgtgttaaaagattcgatgttatttttcgcgttgcctgaaatctgatcatccagcgaattgctcgccgtatggtatgaactgaattctaacacgagaatcggtatgattaagatcacgataaatgaaatgattaatttccgtgaaatcgatgcctttgtgcaccaattaatgaattttttcatattaagctgctccctcaagtgtgataccttatatatcggctcagtcttcacattttgttaacatttcctccttttttatcacttgattttcattgcccaagcttcctgcatatcttataaaaaaagatagggggcgcgcagatgattatcatatccggccaagtgcttcggcctcaggacatcgcgaactggcagacggaagaaagccttgttccgtatataaatgaactgctcaattctcccgtacaattcgattacgggtcgattgctgaactgatgttcgaggtgcggctgcgccgccatattgtggaagccgcaagagaactgcacggatcaggtgtgaaatttgcaactttcgccaaaacatacggaaatacggcttattggagactgacgccggaaggagccctggagctgaagtacaggattcccgcttcaaaagcgattcgggatattattgaaaacggggcgttttacgcatttgaatgcgctaccgccattgttgtgatttattatctggccgtcttaaagacaatcggtgaagaacggtttaaccggcgtttccgggatatcactttgtatgactggcactatgagcatctgccgatctacacggaaaccggcagccactttttacggggagactgtttatattttaaaaatcctgattttaaccctgcaaaggctcagtggcggggagaaaatgtcattgtgatggggaatgatcaatatttcgcccacggtctcgggattctgaccgctgaacaaatcatccagagattgaattctttaagaaaaaaaaatgccgtgcagccggcttatctgcttaaccaggcaacaaggcttgatgcacccgcgctttatcagatcatgcattaaaacaatcccatcgtctgtcattgtgacgatgggatgtgaaatgcttttcttttccggtaaaaagccgtcgtgccgagcgcttggtttgcagcccattcaaacttctctaaatcatggcgggtgacggctctgtcccgtctgctccatttaatggcgcggacaaagtaataccctttaatcggcgccatggtgactttggaatgcggaaaatcttcaaagacaaactcaatagtccctctttttttataggacatttgaagaatcttcatcatccatcacctcacgatttctggattatgattcgcacaatctgtccaaaacggttttcacgtctgtcggcccctcaagtttcgcggcggactggccggcccataaagacatatgctccgcgtctcctgattgagccgcgtgcccgcgcatcggctttgtcagcgtattatgcagcggataaggcagcgtttttccctcgtcagcttcatatgttttcatgaactgattcacgattccccgcgcctgttttcctgaaaacagggtggtcagccgcgtatcggctccttttgattcggcaatggctttttgatatgccggtgaggcgctgctttcttcacaaaggagaaacggtgttcctacttgaacgccgtccgcacccaaacatcgggccgcctgcaccccgcggcggtcaaaaatgccgcctgccgcaatcaccgggatattcagcgtgtctttagcctgcggaatcagcgccataaggccgagagccggttctcctttaaccggcagaaacgacccgcgatgcccgccggcttctattccctgaaggataacggcgtccattccccgttcttcaaaagccttcgcttcctccggcgttgtcgccgtgccgaaaaggaaacaaccgcttttcttcagcttttccgccgttttttccggcggcaggccgaaggtgaatgaacacgctttgactccgtaacggatcagaagctccgctttttccgcgaaatcattccattcttctttcagatcagagaacggcttggcgtcttttgccctcggaatgcgggctttccatttttcaacaagttccgcctcaggcatctgtctttcttccgggacgaaaagatttacttgaaaggagcggtccgtcagctctttcatctcgataagctgtttttcaagcgcttgcgggctgacgtatcctgaagcgaggcttccgagcgccccttcatttgataccgccgaagccagacgcggcgtgaccagtccgccggccatcggggcctgaatgacgggctttgttaatgataacggactcatccactcactcatttgttttcctccgtttcagccagtattttgatataacatgttctgtttcgcggaccgtcaaattcgcaaaaataaacgccctgccatgttccgagtatcaggcgcccgtcttctatgatgacatgctgagaggcgccggttgtactcgctttcatatgtgccgccgtatttccctccatatgccggtccagttcgtgctcccacggatacatttcatcaaaccttctgagcatatccctcttcacatccgggtcggcattttcattgatggtaatgccggcggtggtatggggacagtatatgagcgccaaaccgtttcttacgcctgtttcgcggagaaacgattcggcttcatgtgtgatgtcgatcatttcatcccttttgtttgtttgaatctgcaattttttcagcatatgaatgcctcctttctttttctcttcctttcccatattcgtttctgtatttgtcttttcctgtcggatcgcgatgataaacacagatcacaaaaaacttcagcctcgggactgaagtttttcaccatatatatacgcgggcctcataaggctttaagaggaaggatgtcacatggcggtgcgattctgtttccacgtttgcaagcacgagagaatcggagtcaagcggataaccgggatgcctgtataaagcgggggttcgggacagattggtgatgatcagggcggtttttgttccgttttttcttagataggcataaatctgccggtcattcggaagcagcaattcatatgtgccgctgatcaatacgccgtgtttttttctgagggcgagcagccgtttgtagaaatggtatacggatgtttcatcctgcaattgtgatgcagcgttcagccatgtgtggttcggattcactccgagccacggagaagcatcagaaaacccgccgttcgcctcaccgctccattgcatcggtgtccgtgaattatcccggcccttcttccagatgatcttcatcacttgttcatgcggaacgccgcgggacgtctctttttcatacagatatttaattgcggcgtcatcataatcttcaatggatgggaacgaaacattggtcatgccgagctcctgtccctggtaaataaacggcgtgcctttcatcagcatatacatcacggcgagtgccttggcgctttctgtcaaaaaccgttcgtcaccccataccgaaacggaacggggctggtcgtgattttccataaataacgcattccagccctttccttcaaggctgtactgccagccggacaagacgcgcttaagcgccggaatggagatgctttgatcatcttccgtatcccagaggccgagatgttcaaattgaaaaatcatttgaaagacgccgttttcttcaccggcccaatcagccgcctcccaagccgccactccgttcgcctcgccgaccgtcatgatcggatagcgcgaaaatgtttcccgcttcagctcttttaagagatccattatgccttccccattcatatgatacgggaaagacgggacgtacgggagaccgtccgggttcggcatgtcagggagcccttcttttttcttaatgtgagaaatggcatccacccggaagccgtctatgcctttatcaagccaccagcgaaccatctcataaacggactgcctcatcgcttcgttttcccaatttaaatcaggctgttttttgtcaaacaggtgcaggtaatactggccggtctcttgatcatattcccacgccgatccgccgaaaatgctttcccaattattcggctctttgccgttttttccgtctctccagatgtaccagtcccgtttttcggaatctttcgctgagcgtgattcgataaaccaagggtgctcatcgcttgtatggttaatgacgaggtctataatcagcttcatgccgagcgcatggacatccgcaaggagccggtcaaaatccttcatcgtcccgaattcgccggcaatttgtttataattccgaatatcgtagccgttgtccgcgcccggcgagtcaaaaacgggacaaagccagatcacatccgcccccaactcttttatgtaatgaagctttgctctgatgccgttaatatcgccgattccgtccccgttcgaatccataaagcttcggggataaatttgatagacggccgccgttttccaccaatccgttttcataccgacactcctttctttacagcatatgaaggagcgggacgaagaagcattttttccataaaaaaagcctcattgcaaaagcaggaggctcagaaatcagtttttttaatctcaacgaagcggatatgatggtcttccgcttccagcaccttaaattcacacccttcggcatgaaacacatcaccatttttcagctccattttttgtgttaagagccagccggcaatcgtgtcaatgtcttcattttcgatggcgatatcaaggagatcattcacctcttctatgagcgccttgccgtccatcacataatggtgttcgccttttttgacgatgtggggcatttcatcctggtcatattcatcacggatttccccgacgatttcctccaatatgtcttcgacggtcacaagtcccgccgtgccgccgtattcgtcaacgagaatcgccatatgaatccgctccttctgcatgcggatcaaaagctcctgaacggggatgctttcaatgactctgatgaccggacgcatcatttcttttaattcaatggagcggccgagaaaatacgctttaaataaatccttattgttaataatgccgagaatgtgatctttgtcttccttaataaccggatatcgcgtataccgttcgttgatgatcaaatgtatggcttcatcaactgactgttcaagcgagatgacggcgatttcggtgcgcggcaccatgatttctctggcgacccggttatcgaattcaaatattttattgacgtaacggaattcagattgattgatttgaccttttttatagctttcggacaaaatcagccgcaattcttcttcactgaccacgacctcatgttctttcaccgaatgaaaaccgaacagcttgaccaaaaatccggctgagccgtttaacagcttaataaacggatacatcactttataaaacagaatgagcggtttcgccgtccacagactgacagcttcggctttttgaatggatatcgttttcggcgcaagctctccgatgacgacgtgcagatacgtgacggcgataaacgccgcaataaacgtgacgacgtgcgtaatagatgacggcattccgatcaggctgaaaacaggatgaagaagccgctgaatcgtcggttcaccgagccagccgagtccgagcgccgtaatcgtaatgccgagctggcacgctgataaatattcatcgagatttgaaatcaccctgtgcgccgcgagcgcccggctgtctccggtttcaaccagctccgcgatttttgaaccgcggattttgacaatcgcaaattccgcagcgacaaagatggccgttaatccgattaacagcataatgagaatcagttttaatataagcaaaaaaacccctaccgcaaacggtaaggggccacctccttcgtgttaattctcatcacgaccatttaagaaaatcatcacaaaacgaagcagctcgaataatgaaacgagcgccgcagccacatacgtcagcgcggcggcgttcagcactttattcacgccgtgttcttcactgttgcgaatgaatccttccgacacgataatccgcttcgccctcgcgctggcattaaactcgacaggcagtgtgacaagctggaaaaaaacagcggccgaaaacaaaataatgccgagtccgattaagttcaagctgcccaggagcatcccgcccaagaaaagcagaggggcgaccccggaggcaaaattgacgaccggaaaaattttgtgcctcagcacaagcgcgccgtatgattcctgatgctgcaaagcatgtccgacttcatgggaagcgacggaaatggcggaaatggagcggccgtaatataccggctcagataaacgcaccacccgctccgtcgggtcgtaatggtctgttaaagtgcctcttaccggttctaccggcacatcatataaaccgttaatatcaagaatccgtcttgccgtttccgcccccgtccgctgactggaggcttccacgtctgagtatttctgaaaattgcttttcactttaaattgtgcccaaaacgacaaacccaatgcagcaattgttaaaaagataaacagcatattatcctcttcctttttctcttatatcgtacgatctgcttatatattattttaatgattgcccgctttcctgtacagaaatccgcttcttttttctgacaggaatcaatcctccgagcatgatgaggatacacccggccattccgatgtaaaacggaaacgtgcctgcggtctcttttgcaaaaacaagccatgaaaatccgccggacatgtgattgtatccattcaaatcgaaaataagcaatacggccgccgaagcaagcagctgcgctccggccagcgccgccaacagtttttgaatgaccgtcatttgactcaccctttttcggtccgctttctttatcatatgaaaaaataagggtgaatatgttttcggcgatttttgaaagacatcaaacgaactgggacatactgtataaaaaaagatacaggtgtgatcgacatgaaagtgacaaatggcgagaaagaacagctgagcaatgcgatagacagaatgaacgaagggcttgacgccttcatccagctctataatgaatcagaaaacgacgaacctctcattcagtttgaagatgagacggccgatttaatcagacatgcgcgtgactcatacggccaggaacagctggacgaaaaactaaacaccattattaagcagattttatccatctctctgtcgaaagaagagccggacgaatgaaatcaaaccgtatttttatttcctggctgagatggccgttatatgttcggatcgggctgatcattatcgccttgattttattgttcggccaactcatttacatgctcgaaccgaagcaattcacgtctgtgtttgaaggggtttggtgggcggtcattacggtggccacagtcggctacggcgattacgttccgcagacgccgctcgggcagattgccggcatggtgcttgtattaagcggagcgagttttgtgaccgcctatttcgccacgctttcttcagccgtgttcagcaaacagcaccgctatgtcgaagggaaggtcgcctttaaaggcaaggggcacgtcattcttatcggatggaacgaaaaatcgcatatgctgctgaaagagctgcagcacatcgcaccgtcaaaaactgtcgtcctgattgatgattcattaagggaaggtccgcttattgaaaacgtccatttcatccgcggacatgccgctgatgacagcacgctcaataaggcgaatattacggaagctgataccgtcattctgacagcggaccagcagaaaaatgaatccgaagctgatatgctgtcggtattaacgcttctcgccatcaaagggctgcatccgtctgtttattgtatcgtagaaattttaacggaacggtatgtcaaaaacgccgagcgcgcaggagccaataagattctgtgcacatcacacctgtcgagccgggtgatgtttgagcattaccgggtcaagctgcagcttgccaaaccgcaaacgctgtcagatctgacgctggagaaaaaggtgcgcatcattcccgtccccgaggaactaaagggctcatcttatcatgactgcgcgctctattatctcagacggaataccacgatcatcggcatacaaaaagaagaggggccgatgctgacccctcccctgtcataccaggtgctcgatactgatctgtttttggctctttaatgcagcaggacgtcttccagctctttcacaagcgagatgccgatatctgtatatgagcggtcaattgccgcatcccgccgtttcggttcggagaattggttgaataatgactcaaaaacaccgccgcctgctgcatcatccgtttcctgctgataaacgtgcctcagcaaaaagggtgtgccgattgtaacggcggccccccgttcatccaggtgtcccttatttgcttcaacagggatacggagaaataaatagccgtcctgatcggaaattttgtaatcaaagaacccgcggtcatactcccagccgcctccgatggtataaccgatcggtttcatcacctgttccagttcgcggagtaaaaacgattgaccttcaagtgaagatggtatgctgatcatgtgcatatgctcctttttgtctttagcgtccccgctctgcggtatcttcatacggcgtccgggaagaaccgggagcggcagacagacgctgaaaagaggtgacggcgcattcaatcagaacatacgtcacaattgcggagagagcggcttccgttgaaatatagaaaacggcggcatagagacagcacttcgtgatcagcgtatgcatccggccaatcttcagtttcagccggaccatgtccgtaaacaagccgagagggaaagcgaaaaacaggatggtttgcaagagggattcgggagacagttttagtgccgaatagacgatagcggcggaacagacggaaatgaagacatgcttacataaaagccgcatcaattcatcatcacacctttcacggtttaaaaaaggctgacccgtcatgctgagggccagcccttctttttatttttcaaggcgtttttcaagctctgcttttttctcttcaaagcccggtttgccgagaagcgcgaacatattcaccttataggcttcaacacccggctgatcaaacgggttgactccgagcagataaccgctcatcgccaccgctttttcaaagaaataaacgagatatccaaatgtatatgcgttaagctccggaatattgacaattaagttaggcacttttccgtctgtatgggcaagcatcgtgccttcgaacgcttttttgttgacgaaatcgaccgttttgccggctaaataatttaagccgtcgagatcattttccgcttcttcaattgtcagctcatgcttcggtttttcaacgtttaatacggtttcaaacagatcacgtctgccttcctgcacgtattgaccgagagagtgaaggtctgttgagaagttagcggaagaaggatagatgcctttttcgtcttttccttcactttcgccgaagagctgcttccaccattcagcaaagtattgcagcgcaggctcatagttgatgagcatttcaatggttctgcctttattatacagaacgttgcggacgacggcgtattggtaagccgcgttctcttctaattccgagctggaaaagtctttgcttgcatcaagagcgcctttcatcatttcatcgatatcagccccgcttaccgcaatcggcagaaggcctaccgcagtcagaacggagaaacgtccgccgacatcatcaggaataacgaatgattcgaagccttcttcattagaaagcgtttttaaagcgccgcgttctttatctgttgtcgcgtaaatccgcgctttcgcttcttcttttccgtatttttcttcaagaagtttgcggaaaatccggaaagcgattgcaggttccgtcgtcgtgcctgacttagaaatgacattgatagagaaatcagcgtcttccaaaagatccataacatctttcatataagttgagctgatattattgccgataaagataacttgagggtttttgcgcttatctttcggcagaacattatagaaagaatgattgagcgcttcaatcgccgcgcgggcgcctaagtatgaaccgccgatacccacgacgagaagcacgtcagaatctgatttgattttttcagcgctttttttaatgcgcgcgaattcttctttatcatagttttcagggaggtccacccagcctaaaaagtcgcttccggcgcctgttttttcatggatattatggtgtgccgtttttacgaaatcacgtgcgtatgtaagttcatgttcattgaaaaaaggtaacgctcttgagtaatcaaagcgtacatgcgtcatttgcttgtccctccatcacggtgaattgttttctctttcactttatatgaactcacccgctaaatcaagtcatgaagaaggcatgatgaatacgggatttgcgctgaagatgcgctcattttttatacaatatcccggattcgaaatagttatatttgtaataatcgtgaaagaggtaacgaatcgaatgttggtgatccaggaacgtatcacctttactttggagcaggttgacatccatcgccaataccgatgggacggttctttttatatagtactcctcttgagaggctgctaagcaggcatattaaggtataaatgtccatttttaaaaatagtgtctatatttgggttatcatgttaagatgaaaataattttaaaccgggaggtgattctttgactaaaaccattggtcttatttgtggaagtttacgaaaaaactcgtataatcgagtgattgctcaatcattgattgacttcgataatgcggctcaatttcgctgggttgaaatagacactcttcctttttttaacgaagatttagaaatggccggagcaccagactccgtaacatcctttagagctgatatacgagacgttgacggcgtcatcattgtaagtccagagtacaattccggaatcccggggtattaaaaaatgcattggactgggcatcgtgaccgcggacctcttccgttttaaacagaaaaccggttggcttaatcggcgcaacccccggagggttcggcacctcttttggtcaaatgcaaacgagagaagtactcgaagctatgcaagtcaatgttctgccctttcaaaaaatgctgatttcgcaagtccatgagaaaattgattccgctcaacacatacttacggatgaacaaacaaaacgttatcttcaacgctatttacaacagttcatccattggattgatcatgctccggttcccattccggattaattgaaagatcatcaccttcacgaaaagtcacttcagaaataactttctacctatacagtatatgaatagatttaccgttttccattgacaaactgacttgccttaattcaaggaggatgataaaatgtctgatctttattcccgtctttcaaaagatgattctgccgtgcttttagttgaccatcaaaccggccttatttccggtctcgtgcgtgactatggcgttgatgaatttaaaaacaatgtattggctctcggtgatacggctaaattctttgatttaccggttattttaacaaccagctttgaaaatggacccaacggaccgctcatgcaagaactcgttgatctctttcctgatgcgccaaaaatagcccgtcccggacaaattaatgcatgggacaatgaagactttgttaaagccattgaagcgaccggcaaaaaacagctgattatcgcgggggtggtaacagacgtctgcgttgcttttcctgcgctttctgccattaaagcaggctacgaagtgtttgttgtgacagatgcttcggggacgtttaataagcaagtagcagatgcatcattaacccgtatggctcatggcggcgtgcagcttatgaactggttcagcacagcatgcgagcttcagcgtgattggcgcaacgatgttgaaggttttggcgcattagtctccagtcatcttcccggttatcaaaacttaatgggaagctatatgggggcgcagcgggaccttagtacacaaaatgcataaaaaggagcgctgattgaatcagcgccccttttttaaattcgcggctcttcatcttcgtgatttagatttcgtgtaaatagatgacagacaatcgcaaagttaattggtcctttacggatgaaacgatttccatagttgtctcatggaaaagggtgtttcacttgctcctaatgaactaatagaaaatccggaaagagggactcccaaaacggttacatctgcagcttgaaaatcactccggccgggaatgtatcttacagtgacgcctttaagatggcaagtacatcatctttgttcagtttttggaaattgccgaatccgccgtattccatttcttttgcggcgatgtctgcgatcagctcaagcttgtcttcgccgatgtcataatccgcaaggcgggacggtgcgccgaggcttgtccagaacgcggacaatttatcgatcccttcaagcgcaatttctttatccgttttgccttcagtatcaatgtcaaacatattaagcatgaggtttttaaaacggtccacatttgtatcaagcgtgtatctcatccagttcgggaacagaatcgcaagtcctcccgcgtgagggatgtcataaaccgctgatacggcgtgctccatcgtatgggaagcccaatcgccgaaatagcccatttgcagcgtgccgtttaatgcgatcgtacccgcgtataaaatcgtttcgcggtgcttatagttctcaaggtcttccaaaagtttcggcgctgtttcaattaccgtctgaaggaccgcaaaacacattctgtcctgaagcggcgtgttttcaacattgtggaagtattgttcaaatacgtggctcatcatatccaccatgccgtatacggtttggttttccggaacgctgaaagtattctcgggatctaaaatggagaaacgcggatgagtgacattgctgccccatacgaatttttcgtttgtttcccaatttgtgataacggaatcagggttcatttcagagcctgtcgccgcaagcgtcagcaccgtgccgaacgggagcgcgtcctgcgccgttacttttttgctgtaaatgtcccatgcgtcgccgtcatatttcgcaccggccgcaatcgcttttgtacagtcgatgacacttccgccgccgactgcgagaaggaaatcaatctcatgctgtctgcacagctcaattcctttatttaccgtttccagacgcgggttcggttcaacgcccgcaagttcatgaacggctgcgccttcttcttttaaaatgcctgttacttggtcatacaggccgtttcgcttaatgctgccgcctccgtaaacaagcagcacgtttttcccgtattgcttcagctcttttttcaattggtcgatttgaccttttccgaaaatcagtttcgtcggattgcagtacgtaaagttctccatttatcatgacctccaaaaaaatcgtaagggaattactataacacagaaaaaaaggagctgccaatccggccgcccccctttatgttattacaatgatgctttcagtatcgcaagcacatcttctttctgcagtgacttgaactgtccgaatgctccgtttgccatcgctttatctgcaatcgtatccagcttctcatcagaaatatcgtaatcagcgagtctgttcggagcgccgaggctcgtccagaattcagacagcctgctgattccttcaagtgcgatctcttcatctgatttgcctgtctcgtcaatatcgaaaacacggacggcaagctgtttaaagcgggccggattttctttgagcacatgtctcatccagttcgggaacagaatcgctaaacctccggcgtgcggtatatcgtataccgctgataccgcatgctcgatgttgtgtgtggcccaatcccctcttgcgcccattgacagcattccgtttaatgcgatcgtgcctgtatataaaatcgtctcacgaagctcatagttctccagatcgttgatcagcttcggcgctgtttcaatcaccgtgcgcagaagcgattcacacatccggtcctgatacggcgtgtttgacgtgtggtggaaatattgttcaaacacatggctcatcatatcgaccatgccgtaaatggtgtggtctttcggaacggtaaatgtgtttaccggatcgagaatagagaatttagggtaaacgagcgggctcccccatccgtatttctcttgtgtctcccagtttgtgatgactgatccggagttcatctctgaaccggtcgccgcaagtgtcagcactgttccgaacggcagcgcttctttcggctggtgttttttcgtgacgatatcccacgcgtcgccgtcatatttagcgcccgccgcgatggctttcgtgcagtcaatgacacttccgccgccgacggccaataagaaatcgatgctgttttctttacagatcgcaacacctttgttcaccgttgagacacgcggattcggctctacgcctgccaattcatgtacggtaactcctgcttttttcagcaggtcggttacttgatcataaagaccgctgcgcttaatgctgccgcctccgtatacgagcagtacgttctttccgtacggcttgatttcttcaggaagtttttcgacctctccctttccgaaaatcaatttggtcggattccaatatgtaaagttttgcatgacatctcctcctttggatttatattatgcagaaagttgacgttcaatgtaaagcaatccgcttttttgacggcacatcacacggtttacagacagcggtttcccgggaaaggcacttgtacagcttgagacagtgtgtgatttacacggcggagaatgtagtatgcatagattctttgctttgtcacaatctataactgtttcacgaatttatagaggaggttgtttacatgagtgttattcagcgtatctgtctcgtattaacgattatcggcgctattaactggggactgatcggatttttccaatttgatttagtagcagccatcttcggcggccaaggatcagctctgtcgcggattatttacggtcttgtcggcatcgccggtctgatcaatctcggcctgctgtttaagccgaacgaagaaacatcccgcgaggaagcggcaaatccggaagtcagataaacataaaaaaagcaccgaacatacatatccggtgctttttttgatggttattttttgataaggtctttgcggttggactgttcaatccactcttcaagcttatctttcaatgtgttgaaaccttgcggagcagatgtttcttcagaaacttgtgccgctttcggttttcttggtttgctttcttttctttcaggcgccgcttgagtcgcacggatagaaaggctgattttgcctttttcttcgtcaactgcaagtacttttacttgtacttcgtcaccgatagaaaggtgttcattaatgtcttttacgaaaccgtgagtgacttcagaaatgtgaacaagtccttgagtttcttcatctaatgcaacaaacgcaccatacgcttgtaatcctgttactttaccagtgtaaacactgcccacttcaaattttgctgccattcataacaactcctaagttaaattaaatacagattatacgcaatttaaaattatatcatacaagtttgtttttcgcaaagagaacttttttacatcatcatgtttaagcgcagataaagggggtatactatgattacgaaggctttctagtattccccccttttatttggatgcgaaccgggttcgtatctttttttatgcccttttttcaacaaaccgtttgattctgacgagcgcttcctgaatctgctcaatggatgtcgcataggaacatctgatgtagccttcgccgctcgggccgaatacattccccggaacgacggctactttttcttcaatgagcagctgttccgcgaattcttctgaactcatgccggtcgactgaatggaaggaaaggcgtaaaacgctccgccggggtggtggcagccgagtccgatttcgttcaatgtttccacaatcaggtttcggcgtctccggtagctttttttcattctttcgacgtcttcctgaccgtttttcagcccttcaagcgccgcgtactgagccatggaaggcgcgcacatcatcgcgtgctgatgaattttgagcatggcatccctgatcacgggaggcgccgccgtaaacccgagtctccaccccgtcatggcaaacgctttggagaaacctgaaatcaaaatcgtgcgttccttcatgccgcggatggctcccatgctcgtgaatggctcatcatacgtcagctcggcataaatttcatcggcaagcacgatcaagtcatgtttttcagcgaaggaagcgatggattcaagctcttctttcgaatagacggaaccagtcggatttgacggcgagcatagaagcagcgcttttgttttgtccgtcagggccgcttcaaaatcggctgctgatgctttgaaaccttttgcagctacagtctgaatcggcaccggcttcgcccccgtcagggtcacgagtgattcatatgcgacaaaacacggttcgggaattaacatttcctctccgggattcataatggcgcggacagcgagatcaagcgcctggcttgcccctaccgtaacaatcagttcactgtcaggcgaataactcaggccgaaccgctgatctaaatagcggctgatttcttctctcagttcataaagacccgcatttgccgtataagccgtataaccctgttctaaagaaagaatactcgcttccctcacgttccaggccgtcacaaagtcaggctctcccactcccagtgaaatgacgccttccatcgtagcagccagatcaaagaatttgcggatgcctgacggtttaatctgctgcacgtagtcagataaataagaagtcttcgtttccatttacggagacaccacgattcttttgtcatcgtctccgctttcaaagactttgccgtcatgcttatattttttcaggataaagtgcgtcgtcgtggaaacgacggactcaagggtggacaatttttcagacacgaagcttgccacgtctgacatcgtgttgccgcgaataacgacagataagtcatacacccctgacatcaggtacactgattcaacttcctggaatctgtatatccgttcagcgacttcatcaaagccgacatttcgtttcggagtgacttttacgtcaatcatcgccgtgacgccttccaaaccgtcgactttgcgccagtcgatcatcgccgcataatcaatgatgactttttccttttcaagcttttcaatgatgcttttgacttcttcggcgggaatgttcgccattttcgcgatcgtttccgcatcaacgcggctgttttcgtctaaaatttctaatatttctgtttctttttccgtcagcttcatacgtttcacacctttgcattatcaaaaatcttcatgacattatatcacgattttcgacaaatgctaagaaaaacccgaaagaaaccagaactaaaatctgacaatcaaaaaagcctttacattacaacaaagaaaggacggcgaaggctctcatggaagctgtttcaccgattaaacgggccgcgatagacggagttgaactgtattacgagcattatgaaaatcccggcagacagacactcgtctgcgtacacggttttttatcttcggcattcagcttcagaaaactgatcccgctgctcagaaaccattatgatattatcgccgttgacctgcctcctttcgggcaatcggaaaagtcacggactttcgtatatacttacgcaaacctcgccaagcttctgatcggacttctggaaaagctcggtatcagccgggccgcactcatcggccattcgatgggcggccagatttccttatccgcgtctcttctcagacccgagcttttttctaaaatcgtcctgctgtgcagctcggggtatttaaagcgctcgcacccgtcgattatattcgggacgcacctcccttgttttgacctgtatcttaagtattggctttcaaaagacggtgtgctgaaaaacctgttaaatgtcgttcacgaccggacgcttatcgatcaggaaatgattgacggttacgaaaaaccatttacagaccgccagattttcaaagcgatgacaaggttcatcagacacagggagggcgatttagagcccgaggatttgaagaaagtgcaaaaccccgctcttttaatatggggagaagaagaccgggtcgttccggtctcagtcggaaaacggcttcatgacgacctgccggattccattctgtattcactcaaggatacgggacacctcgtacccgaagagcgcccggagtttgtttcggaacggatttttgaatttattcaataaaaaaaaccggcggaaccgccggtttttaaggggtgcaggagctgctttcttttatgaacagaagctgctcggcggccttttggcagccttcgatcggtagcttttgctcaaatgaagcttcaaagatatcctgaatggctgctgccagcttgtcggcacggtcttcactgtagacggcctgaacgatgtcgacggcttctgtctcataaaaatcttctccatatttaaatgggtcccacttggcaatgattttcatcatttccatgaccgcttggctttcttccattttcatcaccgcttataataaagtttgcaaatctattttatcatagatacgctgtgcaaaataatgatactacaggagtgacatacatgaactttgatcttcgagaaaaccgtcttggcacacaatcggtgaaatgggacaaggcggaagcgttattcggcgtatcggatgcacttccgatgtgggttgccgatatggatttccgcgctcccgaagcggtcactgacgccttaaaagcccgccttgaccacggcatattcggttatacgtctcctgacgaaaacacaagagaagccgtcgcttcatggcttgagacacggcacggctaccggcccgatcccgcaagcatcacgttcagtcccggggttgtcacggcaatcagcatggcagtacaagcctttaccgaaccgggcgatccggtgttgattcaatcaccggtgtatacgcctttttatcagatgatcaaggaaaacaaacggcaggttttacataacccattacgggaagagaacggcgtctactgcatggattttgaggatcttgagaaaaagctgagcgattctgaggtcaagctgatgattctttgtaatccccacaatccgtccggcagagcgtggagccgggatgagcttatgcagctcggatcgctgtgcgccgctcataacgtcaccgtcgtttctgacgagatacattccgacttgatgctgtacggaaagccgcatacgccttttgcttctctgtctgaggagtttgcgcggatttccattacttgtgtcgcgccgagcaagacgtttaatattgccggcattcaggcatccgccattatcattcccgaccgttataagcgggcgaaattctccgccgcattgcatcagaacgggatttccagcctcaacacatttgcggttgcagcaatcgaagcggcttatacaaagggaggcccttggcttgacgcactgattccttacattgaaaggaatatgaaattggctgaggactttttaagaaaagaattgccgaaagtccgcatgatgaaacctgacgcttcctatttgatctggatggatttcagcggatacggattttcggatgccgagctcaaagaaagaatgctcaaaaaagggaaaatcatattagagccgggaacgaaatacggaccgggcggcgaaggatttatgagacttaatgtcggctgttcagccgccgccgtaaaagaagggcttaagagaatgaaagcagcgctctcttagcagcggaaagaacgcctttatcagatgagataagggcgttcgctttagagaaataaatactttttttgccggtaaagatgttataatagattcatatttacataggaaaggatttcgcataaatggagattgtaaaggattacctgcttcacttctcttttattttattccctatttttctctatcaagtcttctggctcagcaagcccgatttgcttgtgccgagagcgaaccgcctgctggtcgccgtatttgcagcgtcatcttccttattatgtacggcttttcccatccaggagcttcattccgtccgttacggtttgcagctgattcccattatcgtctgcctgctttattccggtaccgcagcaggacttgccgcaggggcagcatccgttttttttcagctcatatggtttgaaccttccgctctttttttcttatccttaattccttttttaatcatcatccctatccagctccaaacgaaatggccttttttctcaaagcggaagaaactgcttttcgctcttctcatcggctgcactgaaaccgccttattaaccgcatctgtcttcatctattccgcgaccaatattttcaattttcaaaatctatcttccgtttattatgaggcggcagtatccgttttttttcaagtcagcgcccttttgctgtgcatttatttgattgagatcattgatgagaatgcgtccatgcgggcaaggctgattcactcagaaaaaatggccgtcgtcagcgagcttgcggcaagcgtcgcccatgaagtccgcaatccgcttacggtcgtcagaggttttgtgcagctgctgttcagcggcgagcagcttcaggacaaatcccactccggatatcagaaacttgtgctgtccgaactcgaccgggctcagacgatcattacgaattatctcgatatggcgaagcaggatgactatgaaaaagaaaagtttgatatttctctgcttgtaaaggaaacaggttccttaatggagtcttatgctaattttaaatcggtgaccgtgactgttcaaagcgagcctgatttatatgtgttcggcgatgtaaaaaaactgaaacaggccttcattaatctgattaaaaacagtattgaagccgtgccctctgaaaacggccgaatcgaggtctccgtccaaaaacaggaagagatgattctcattcagattacggataacggaatcggcatgtccgatgaagaactgcagaaactcggcaaaccgtattatacgctgaaaacgaatggcaccgggctcgggcttaccgtgacattctcgattattcagcatcatgaaggctccgtctatttcaccagcggcgagcactcgggcacaacggcttcagtcaggcttccggcagctgttcactagccaatcgcgttgatcttttatagaataactagagagaggtgaacgctatgaattcgtttgaaatcggcacaatcgtaaaagggttttataaaacaggagcatacataggggaagtgacagacgtcaggcccaatcactatttagtgaaaattaaagccgttctgacgcatcccgctcaaggagatcttcatcatccgaagcaggcggatgttccgttctttcatgaaagaagagcgcttgcattcggggaacagacaaacataccgcatcagatggtcaaaccgtttgatggcgaagttcctgattatacggcttccttacaagcggcgtctgcccggctgaaagatcagcttacagcggacggctcagaatgggcggaacgttcgctcgccaacttggccgcgttagagcgtgactattttaaaagaacttgacccagtcggcatgattgggtttttttatgtggcccgtcgaaacagttcagtcagatcgacgcgatcaccgatcgtcgggggtttcggtttttcaagatattgtttatcccgctcgacaagcttgaataatttgtatgtcgtccgcgcatcatccagcgctttatgatgcgtgcccgtccctttatcgccatactcttccgccgctttccaaaggccggtcaatgttctgtcgccaaagaagtttttatattctagggacagatcccgaagttctcctttgaacggaaaagggatgtggttaaacatgcaattttgctttaacactttcatatccatattgccccaggtgacgatcgtgcagtttttatcaggatcaagctcatttaatttgcggatgaattcattaaacgtgattccgccgtccacgtctttttgggtgatgttcagaaaggttttgcatcgtttcgtcagctttggaaattttttcggtttgatataactcgaaaacgtttcagtcacttcatcattcaccgtcttgacaatccccgcttcaataatctcgggaaagaaattttgcgggctgtattttccgtcaggcatcgtaaattcaaaatcaataatgagcagactgcgctgatccacttttttacacctgcctttcctccgatcaaaaatgatattttatgatagtatatcagtttcccctctgaaactttcttcattttctaaaaataatgaattttcctatatccgcatcgaaaatacaaataccggattcattcctatatactaatgattagacacacgaaaattaaagaaggtgatgttatttctgtccgtaagaagaacttcgtcgtcatttggattacaaatttctttatttccgccagcatgaccatgattgttccgtttctttcgttatatatcgaaacgatcagcccccattcgggcgggtatgtgcagagatggagcgggtatgtgttcggcgtcacgtttttaatggcgtttgtgatttccccgttttggggcagattcggcgataagcgcggctacaaaaaaattctcttgatcacaggcaccggcattgccgtcagcattttattgatggggtttgtgacatccgtttatcagctgtttgtcctccggctgcttatgggccttgtaacgggctttgttccgacttcgcttgccatgatttcggcgcagacgccgaaagagactgccgggaaaacgctcggcacgctgcagatgggtcaggtgtcaggcactttattcggaccgatgctgggcgggctgctcgctgacagcttcggatttacgtacacattttttattacgtcttttgtcattttcgcatctgtgcttctcgttttatttcaggtgaatgagcagccgctcggcgagaaacaaaacaagcggaaaacctattccagaaaacaggtgctctcctatatttttcaccagcccgcgctttgggcgatgatggtgcttaccatgatcgtgcagaccggcaatttcagcatccagccgctgctcgctttatatgtcaatgagctgcacggacctgttaatttagcctttttctccggaatggcgttttcagcgaccggactcggaagcttattgcttgcccggaaatggggggacttcggcgaccgcttcggccacagccggatcttaatcgtgcttttgattgcatcagcggtgttttttattccgcaggcgctcgcctcctccctctccattctgttagtcttcagatttctgttcggcatggtcatgggcggcacgctcccctgcattacggccgcgatccgcgtcagggctccgggcagcatccagggagaggtgctcggatataacgtcagctttcgttttctcggaaacgtgctcggccctctgctcggaggtgcggtctcaagcggtttttctatttcggctgctttctacgtcaccgcctttctcttttttataggcgcggggcttttatggatggcgggacatctgcaaaaggatacagcgtcaaatgcgggctgaccggcagcgatcacgatttcttctaaatttaaccttctcgtattcttaaaagaatgatacgatatggctagaaatcaggagaaaagagagtgaccatggtacgtaaaataatcggatggattttgctgctcggcattatcccgttgtgtgcatttacagttattgcttccggcaaagaggtaaaacaaatcaagccttttgatcaggtgctcgataaacatattgatttaaaagcgatcaacctggttcaaaacagttacatgtatgacagggacggaagccttgtttctgagattgtcagcgatcatgagaaccgcgtgatcgtgccctttaataaaataccgaatgaggtaaaacagctgtttttaacctctgaagaccgccatttttatgagcataaagggtttgactttatggggatggtcagggcggccgcctccaatttcaaagatcataaaattgaccagggcgccagcaccatcacccagcagctggcaaggaatgtgtatttaagccatgaacgcaccttcagccgaaaactgacggagctggcctattcctatcagcttgagaaaaaatacagcaaagatgagattttagaaggctacttaaatacgatttattttaataacggtgtatacggtgtcggttcggcggcacaattttatttcagcaagccgctgaaatctctcactttgggagagatggcctttatctgcgccatccctaataaccctacattatatgatcctctcaagcattttgattatacgaaaaaacgacaagtcagattgcttaacggattgaaaaaagcaggcgttatatccgggaaacagctgaaaaaagccgaaaaggaaaagatcaagcttgatataaacgaaaaaacaaataaatatcctgactatgtttcctatgtaaatgatgaattcacacagcttgtttcctcatccgaaggctatgacaaacgtcttgaaaaagcttccggaaaggcgaaacaaaaaatacagagtgagctttccgacagagtcagcacattgttaaaagacggcgtgaagatttatacggcgctgaatccgtatatgcaaaaccaggtcgtcgcccaagtgaatcaaaatctgccgtatgcaggcgtccagggcggagcggccgtgattaatcatcagacacatcagattatcgcgctttcaggcgggaaagattatcataaatatgatttcaaccgcgcctatcaagcatacagacagcccggttcatccattaagccgctgcttgattacggaccttacattgaaaagaccggcgcaacgccacacagcaaaattgacgcaagcaaattctgcagtgcggattactgcccgcagaactataataaccgcacatacggcacggttacgctggaaacggcgtttaaatactcgtacaacacaccggccatcagaatcatggaccgcgtcggcgtcaataaggcgttcagctaccttgaaccgtttcatttcgcgaagctggtcagcgcggattaccgcctgcctgcggcgctgggcggttttacaaacggcatgacgccgcttgaaatgaccaatgcgtacaccacgttcggcaacaacggcgtttatacgccgagtcacgcgattacaaaagtgactgatttaaaaggaaaaacgatattaaaatggaaagatgagccggcgcaggtattcagcgtgcggaccaacatgcagatcaaagaaatgatgaaagccgtcgtcaaaagcggaacaggaaaaaaagcgaactttaaagctccgtacgtcggcggaaaatcaggaacgtcaaatgactatcacgatatgtggtttgtcggcctgacggacgcttatacgatgggggtatgggtcggcaaggatacaccgtcaagcgtcgaataccttcatgacgcaagccctcagctttcgatctggaaaaacacgctgcaggcagcttattaaagataacggaggggatccgctttgaaaccagctcagcttccggaccgcgtgcttttgtttgacggcgtctgcaacttatgcagcggcgccgttcaattcatcattaaacgcgatccggccggcaaaatctcatttgcttcattgcaatcagataccgcccgggagcttttggcatcagaaggacttccgacagaacaatttgacagcatgatttttatcgaaaacgggcggatatacaaaaaatccgcagccgtgttaaaggtttcgcgtcatctccgcggagcctggcggctgtcagcggtttttttcgcagtgccccgcccctcagggacagagcctattctttcatcgcccggcgccgttacaaatggttcggaaaaagggaagcatgcatgctcccctcccctgagatcaaaaacagatttctgtcttaacaaaaatggctagcttacacaggtaagctagccattatgctattataaagcttgataaagatgtacaaaataccgataacaaaagtaaaccaaaacagaatctcaagcaatataaaaccgatcagcgaaacgatcgagagtgtcgaatagattctgtacaccatgaaaatcaaataaatgagcgtaacaacggcaaataacgccgcaatccaaaaaccattctgcacgaacgcaaaggaaagaattcctccgcctacataaattaaagagcctaatctgatttttttcagattgtccccctcagggtcatttgtgaaaaacaaaagagacagctctgtcactgtgtttgcaatcagcttcaaagccgaaaaaagcataaaatacacaagggcgaacgctgcaaaaagcgccagtctgatccctttctcagagaaataatccagcatcccctgatacatgccgagcgtctgaagtatcttcatgacataaagcgaggtagaaatggataatgacgaactaaaaagcagaatcgcaacgagcggaaaataacccgtccaataagtatttttcatataaaaagtccctttctgtaatctacctcacttattatggaggacttaaaacacattgacaagataaaaaattccatttttcctcacttttacgaaataagggcctgatcttcacaaaccggctttttcggagtaaagtagaacgcgggaatgataaacgtaaggaaggctgttatgaaaaaaacattaaaattgcaaacccggttaacgatattcgtctgtattgtcgtccttatcgcactttgtatcacctttttcacgatcagcgtccagaccgcggaccgcgtgaaagaagaagaacggacaaccgcgctgcgcaccgcaaagcttgtcgcggaaacaccgagtgtcgcgcaggcattgcaaacaagaaaagggctgaaagagctccggaattatacactggatgtccagcatacgacaggaaccgaatttgtcgtggtgatggatatgaacagcatccgcctcacccaccccgacgcaaataaaatcgggaagaaattcaccggcggagacgaacagccggcgttgcacggccatatcaaaacgagcacatcagcgggaactctcggaaaatccatgagagccttcgtaccgatctatggaaaagataaaaaacaagtgggcgtcgtttcggtcggaatttcgcttaacaaaatacaggatgtcgtcagccacagtttgagaccgctttatttcatcatctgcgtaagtatttttgtcggcgtcatcggagccgtcattgtcgcccgcaccgtcaaaaacattatgtacggtcttgagccttatgaaatcgccaccctcctggaagagcggagcgccatgctcgaatcaacgaaggaaggcatccttgcggttgacgcgcggggaaaaattaagcttgccaatgcagaggcgaaacgactttttattaaaatgggtattccgactaatccggtcgatcaagatgtgaacgatattctcccgaaaagccggctgaaacaggtgattgaaacgaaaaaaccgcttcaggacagagatatccgcattaacggacttgagctggtctttaatgaagttccgattcatctgaaaggacaaaccgtcggagcgatcgccacgttcagggacaaaacggaggtcaaacatttagcagaacagctgtccggtgttaaaatgtatgcaaacgcattaagagcccagtctcacgaattcatgaataagcttcatgtcattttagggcttgtccagttaaaagaatacgatgatctcggcacttacattaaagacattgccattcagcagaagacggaaacaagcgagattataagtgatgtcaaaagtccggttctcgcagggtttcttctgggaaaacaaagctacatacgcgagcagggcgctgatctggacattcagctcggcagcctgattccgaatgcggcggatccggccgtcatccatgagctcattacgattatcggaaacctgttaaacaacgcgctcgacgcggtggcgcagatgccgaaaaaaaacattacgtgctcgatgcggtttcaggatcgccagcttgacatagagattacggacacgggagccggaatgtctgcggcagaccaagcccgtatttttgaacaaggttattccacgaaagggacaaaccgggggttcggcctctatttcacccagcaggcaacagaaaatttaaaaggccatatgattgtgacaagtgaaaagaatgaaggaacgactttcagtcttcgcattccgtatgaaccgaaggaggaaaatgatgattaatgtactcatagttgaagacgaccccatggtgggtgaattaaataagcgctatctcagccagattgaaggatttcagctgaaagggatcgcatcatcctttcaaagcgcgctgcacgtgctgagcgagcatcatatcgatctcatccttcttgacatttacatgccgggaaaaaacgggcttgagcttttaacggaaatccgcaagcagaatgaatcggttgatgtcatcgtcatttcggccgcaagcgagctggacgtcattaaaaaaacgcttcggtacggcgccgtcgattatttaatcaaaccatttgaatttgaccgctttcaaaccgctctttccgactacagacgcaagcagaaagtttatcaatcacacagaagcatgacacagaaagaattggatgccgagctttttcaaaagaaagaagcggcggaaaaggttcaccttccgaagggattgacaaagagcacgcttaaactcatctgggcgagcattgagtctttcggcgacggctcttttaccacggaagatctcgccaagcatactgaaatctcgcaagtctccatccggaaataccttaaatttctggaagacatacaagtgctgaatgtagagatggcgtacggcacgatcggcagacccgtctttcaatatcatatcaacaccggcaatgtcagcagcatcaaacaatatttataatgtcaaaaagcgccgtttcgctgtgaacggtgcttttttactgtcatatcccgtgacaaaaggcttgagattcctttttgatatgctatataaggataatgacccggctgatcctcctctgttttaaccagatgaggaagccgattcataaaattgatattttttaaaaaataagcaaatttctatttatttatggcgggtaaaatgataaattatgattggttagcagatcttttcagataagtcataagtcccgaacccggaagagacagccgctcaaggcgggaaaaagagagacgtctcatcattattatcagaaagttttttcgattctgcatccggcacggggactcaagtctgaattgaacggcacagccatattttacaggggggttatatctttgaaaaaacgcaaaatcggaatggcgatggcgctcatcgcagcggccggaaccatattaagcgcatgcggttcaagtgacaaagcaaacggctccggcagcaaaaactttaccgtcggcatggtaacggatatcggcggtgttgatgacaaatcatttaaccagtccgcctgggaaggcatccaggcattcggaaaagacaacgggcttaaaaaaggcaaaagcggttttgactatcttcaatcaaaatcagatgcagattatacaacgaacttaaataaattagcgcgggaacactttgacctgatttacggcgtcgggtatctgatgcaggattccatcagcgaaatcgccgatcagcgcaaagacacacattttgcgatcattgacgccgttgtcaaaaaagacaacgtggcgagccttacatttaaggaacaggaaggttcattcctcgtgggagcggccgctgcgctatcgagcaaaacgggaaaagtcggattcgtgggcggaatggagtccgaattgatcaaaaaatttgaaatcggcttccgcgcgggtgtacaagccgcaaatccgaaagcgaccgtcgaagtgaaatatgcgggcgggtttgacaaagccgatgtcggcaaggcgacggctgaaagcatgtacaaatcaggcgttgacgtcatttatcacgcggccggcgcaacgggaacgggcgtcttcacagaagcgaaaaatctgaaaaaagaagatccgaagcggaacgtatgggttatcggtgtcgataaagaccagtacgcggaaggccaagtcaaaggaacaaaagacaatgtcactctcacatcaatggtcaaaaaagtggatactgccgtggaggacttaacgaaaaaagcgagtgacggtaaattcccgggcggcaaaacattaacatacggtttggcgcaagatgcagtcggcatctcggatcacaaggagaacctttctgacgatgtcatcaaagcaacagacgattggaagaagaaaatcgcggacggactcgtgatcccttcaactgaaaaagaattgaaatccttcaaggctgagtaagaaccaggggataaggagactttcgtgcttatcccctctcttttttgaaaagagcggtgaaggaaaagctgcatctcttgcagcttttcttttgccaagctctttctcatcaaagtatctctgaaaaggagcgacaaatcggtggattatatcattgaaatgcttaatatacgcaaggaatttcccggaatcgtcgccaatgatgacgtcacgcttcaagtgaaaaaaggcgaaatacacgcccttctcggtgaaaacggcgccggaaaatcgacactcatgaacgttttattcggcctgtatcagccggaaaaaggcgagatccgggtgcgtggcgaacgcgttcacatcaacagtccgaacaaagccaacgatctcggcatcgggatggtgcaccagcattttatgcttgtggataccttcaccgtctcagaaaatatcattctcggaaaagagccgaaaactttcggccgaattgacagacagcgcgccgcccgggacgtgcgtgatatttccgaccgttacggcctgcacattgatcctgaagccaaagttgccgatatctccgtcggtatgcagcagcgggcggaaatattaaagaccctctaccggggcgccgacattctcatttttgacgagccgaccgcggtgctgactccgcacgaaattcaagaactgattcagattatgaaaaatcttgtcaatgaaggaaaatcaattatcctcatcacccacaaattaaaagagattatggaagtctgcgaccgtgtcaccatcatccggaaaggaaaaggcattacaacacttgatgtcgcacatacggatcaagatgaactggcaagccttatggtcggacgcgaagtgtcattcaagacggataaacagccggctgaaccgaaacaagaagtgctttcgctttctgatgtaacggtgaaagacgcgcgcggcgttgaggcggtcaaacagctctccctctctgtcagagccggtgaaatcgtcggcattgcgggcgttgacggaaacggccagtctgaattaattgaagccattacaggtctcagaaaaacaaatgccggcacgatcatgttaaacggcaaacagctgcaaaatatgccgcccaggaaagtcactgaagccggaatcgggcatattccgcaggacagacataaacacgggctcgtccttgattttccgatcggagaaaatatcgtgctgcaaagttattaccaaaagccctactcttctttcggcatattaaataaacacacgatttatgacaaagcgcgaagcctgattgaagaatacgatgtcaggacacctgatgaatatacgcctgcgcgcgctctctccggggggaatcagcaaaaggccattatcggccgggaagtggacagaaatccggatcttttaattgcggcccagccgacgcggggactcgatgtcggcgcgattgaattcgtccataaaaagctcattgagcagcgtgacgccggtaaagcggtgcttctgttatcttttgaacttgatgaaataatgaatctcagcgatcgcatcgccgtcatctttgaaggcagcatcatcgcaaacgtcaatccgcttgaaacaaacgagcaggagctcggacttttaatggcgggaagtaagcaaatggaggcggggaaaacacatgattaatcgactttctcatctggctgtgccgctgattgcgatcatccttggattagctgcgggtgcggtcatcatgctcgccagcggctacaatgtcgtaagcgggtattcggctctttggagcggcattttcggtgaagtgtattacatcggggaatcgatccggcagattacgccatatattctgtccggattggccgtggcattcgcatttcggaccggcctgtttaatatcggggttgaaggacagctccttgtcggctggaccgccgcggtgtgggtcggcgtttcctttgacgcccccgcttacatccaccttccgctttcgttattggcggctgcggctgcgggcggcatttggggcctgattcccggatttttaaaagcccgtttttttgtccacgaagtgattgtcacgatcatgatgaattatatcgctcttcatttaaccaattatctcatttccgatgtcatgacggaccaccgggacaaaacagacaaaattcatgaaagcgcgtcgctccgctcgccgtttttagagcagctgacagattactcccgccttcattggggcattctgatcgctctgtttgcggcagtcctcatgtggtttatcattcataaaacaaaaagcggatttgaattccgggctgtcggctttaaccagcacgccgcacaatacgccggaatgagcgtcagaaaaaatatgatgtacgccatgatgatttccggggccttcgcagggcttgccggcgcgatggaaggactcggaacctttcaatatgcggcggttaagggcgcctttaccggcgtcggcttcgacggcattgcggttgcgcttctcggcggcagcacggcaatcggcgttgttctggcggcatgtcttctcggcggccttaaagtcggggcattaaatatgccgattgaatccggggtgccttctgaagtcgttgacatcgtcatcgccattattattttgtttgtggcatcaagctacgccatccgtctcatccttgataaattgaagaaaaagggggcgaagtaagtggacttcctgcagattttatccattattgttccggcaacactcgtatatgcggctccgcttattttaaccgctctcggcggcgtgttttctgaaagatcgggggttgtcaacatcggtcttgaaggactgatgattatcggcgcctttacaagcgtcatgttcaacttatttttcggacgcgagcttggcgccgccgctccgtggctcgctctggctgcggctatgattgccggcggactgttctcactgatccacgcggctgccgcggtttctttccgcgccgatcagacggtaaccggtgtggcgatcaatatgctcgcgttaggagcgacactgtttatcgtcaaactgatttacggaaaggcgcagactgataaaatcccggagcccttttacaaaacgaacattcccgggttaagcgatattccggttttaggaaagattttcttttcagacgtatattatacgtcgattttagccatcgtactggcctttgtttcctggtttattttattcaaaacgccgttcggccttcgcatccgttctgtcggggaacatccgatggcggccgatacgatgggaatcaacgtgttcggcatgcgctatatcggcgtcatgatcagcgggctgttcggcgggctcggcggcggtgtgtatgcttccacgatcgcgcttgatttcacgcactccaccatttccggacaaggctttatcgctctcgccgcgctggttttcggcaaatggcatccgatcggcgcgctcggggctgcgctgttcttcgggtttgcgcagagtttgagcattatcggctcgcttttgcccctgttcaaagacattccgaatgtatacatgctgatggctccttacattctgaccattctcgcgcttgccggcttcatcggccgcgcggatgcgcctaaagccaacggcatcccttatattaaaggaaaacgctgattgccacacaaaaagagttccgcaccctggtgccggaactcttttcatctatatacgattctgatatactcacgcggctgaaacggcgtttgcattgattcagccgcactcagcttgtcttctgcgtattccgcaccgagaaaaaaatgctcccaatcatctgcttccgtctgctgccgcgttttgcagaaatcatcaactatgaatgttcctgcaataatagaacaaaatattccaatacaggccgccgcctttctcttcatctgaccagctccttttgtaaagcttgatctgaaaaagaaatgtatatacaaagatccggatatttgataaatttattttgggttcaaaagaccacaaaaacacaaagaggaatacattatgccgtagcagggtaaaaaaaagtgcgatataatttgtactgggtcctatgaccgtgaattgattgattcattcttacataaagcagttgcttgatgaaaaaacaagcaaaggaggtcttctgttgcagctgttacatttcgcgattttggcgccttttttatttgcatttatcgttccctttctttataaacgggtaaaacaagtccatacaggctggtttgtgctgatagtgcccgttgtgctgtttgtttactttatcagcaagctccctgtcacaatggctggagaaaccgtccggtatgcggccgaatggattccgtccctcggtattaactataccgtttatattgacggactcgggctgttattcgctttattgattacgggcatcggctctttggtgacgctttacagtattttttacttatcgaaggacaaagaaaagctcggccctttttatgtgtacctgctgatgtttatgggcgcgatgctcggcgttgtgctcgtcgataacgtcatcgtgctttatatgttctgggagctgacaagcctgtcatccttcttattaattgggtattggcataagcggaagaaatcacgctacggggcggaaaaatcactgctgattaccgtcggcggcgggctgtgcatgctcggcggctttatcctgctgtatctgatgacggattctttcagtatcagggaaatggtcaaccaggtgcatattatcgcaggccacccgttctttattccggcgatggttctcctgttattgggggcctttacaaaatcagcgcagtttccgttttatatctggcttcctgatgccatggaggcgccgactcctgtcagcgcctatctgcactcggctacaatggtgaaagcgggtatttatctgattgccagattcagtccggtttttgctttttcacccgtctggttttggacggttgcctcagtcggtctgatcacgatggtatgggcttcctttaatgcgattaaacaaaccgatttaaaagcgattctggcattttccacagtcagtcagctcggtatgattgtatcgatgctcggcgcaggagccgccgcgcttcattatgagcattcagagtattttacggcggctgtcaccgcggctgtgtttcacttaattaaccatgctacttttaaaggaagtttatttatggcggccggcattatcgaccatgaaacgggaacgcgggatatccgcaggctcggcggcctgatggcgctcatgccggtaacgttcaccgtttcactgatcggaacgttttccatggccggtctccctccgtttaacggctttttaagtaaagaaatgttctttacaagtatgctgcggattgctcatgcagatattttcagcctggatacgtggggcgtgctgttccccgttctcgcatggatcgggagcgtcttcactttcatctacagcatgaagctgtttttcagaacgttcagcggcgcgcgcaaaacggatcagcttgaaaagacgccgcatgaagctccgctcggcatgctgatttcgccggtgattcttgccgcttgcgccgtcagtctgttttttgctccgaacgttttgtcttacagcctgattgaaccggcgatgaactccatttatcccgctctgttaaccggcggagatacattccatgtccatatttcccagtggcacggggtgacggctgaggtaatgatgaccctcggcatcatcattgtcggcacgatcggttacgtaacgctgtctaaatgggagcgtctgtacggtctgtttccgaaaaaactgacgctgaacaagctttacgatgcggtgacgggcagtatggaaaaaagatcttaccagctgacgtcatcttatatgaccggatttttgcgggattatctgctgtatatctttgcgtcgtttatcattctcatcggagcggcgttcgtcatgaaaggcggcttttccatgacagcgaaaggaatggctgagatcggcctgtatgaaatcgtgctgtccctcgttatggtgaacgcaacgattgcgactgtgttcgccaaatcacggctgacggccattatctcactcggtgttgtcgggtacacactcgcgctgtttttcgtgattttcagagcgcccgatctggcgctcacgcagctcgtcattgagacgatatccgtcgccttgtttcttctttgtttttaccatctgccgaaaatgcggcggaaaaagaagacaagaacattccggatgacgaattttatcatttctctcggtgtcggcgtcatcgtgacaatgctcggaatcgcgtcttccagcgaaaaaacaaaagacagcatctcctcctttttcaccgcttacagccataagctcgggggaggaaacaatatcgtcaacgtcatcctcgttgatttcaggggatttgacacgatgtttgaaattacggtgctgtcgattgccgcactcgggatttacggcatgatcagaacaaaagtaacagaggagggagaaaagcgttgagacagccaaaaacaaacgacatcatccttcagacggcaacgaagcttgtatcttttatcattctgcttttctctttctatttatttttatcggggcataacgcccccggcggaggatttgtcggcggactgattacgtcttcggccatcgtgctgctgcttttggcctttgatttaaaaaccgtcaaatcgattttgcccgtcaattttatttatgtggcgggcgcgggtctgcttatcgcgattgcaacgggtgcaggttcgttcttattcggagcgccctttctcacccatacattcggccattttcatctcccggtgctcgggaatacggagcttgcgacggccactttgtttgatttaggtgtgtatctcgttgttgtcggcgtgacgatgaccattattcaaacgattggagaggaagaatagtggaaatcttaatgtctgtcattgccggtattttgtttatggcggcaacctacctgctgctttctaaaagtctgctgcgcgtgattatcggcaccgcgcttttgagccacggcgtccatttgctgctcctgaccatgggcggactgaaaaaaggcgctcctcccatactgggcggaaaaagcacgtcctttgtcgatccgctgccgcaggcactcatactgacggcgatcgttatttcgttcggcgtcacgtccttcctgcttgtgatggcgtttcgcgcctatcaggaactgaaaacggacgatatggatcgaatgaggggaaatgatcaacatgaataactttgtgatattgcctattctggtgccgctgcttgccgcagtgctgctgatttttatgaacaggcacgtgatgctgatgcggatattcagcactgccgcttcctgtgtctccatcgtcatcagcgccgctctcgttcagacggttttcacacacgggattcagacgctgacactcggcggctggaaagcgccgtacggcattgtgctcgccgcggatcagcttgccgcactgcttgttttgacaaccgccataatcgggctgctcgtcaccctgtactccttccgctccatcggagaaaaaagggagcgcgctttctattattcaggggtgcagtttcttctggctggcgtaagcggagcgtttttgacgggtgacctgttcaacatgtacgtcttttttgagcttctgcttatcgcgtcctacatgctgatcgtgcttggcggaacgaaaattcaattaagagaatcattgaagtatatcgtgtttaacattgtgtcatccgcgttttttgtcatcggtgtcggttacttatatgcggtgacgggcacgctgaatatggctgatctaagcgtaaaaataagcgaatcgggccagaccgggctgataaccgtcatcggcatccttcttctcgtcgttttcggtttaaagggcgggatattcccgctgtatttctggatgccgggctcttattacgccccgccggctgcaatttcggctttattcgggtctcttttgacgaaagtcggcctgtatgccattttaagagtattcaccctgatctttattcacgatacgggctttacccaccaattgatgatgtggcttgcgatgctgacggtgctattcggcgtaatcggatctatcgccttttcggatgtcatgaaaatcgtcatctacaatattattacagccgtcggcgtgattttgttcggcattgccatgaacacgccggcctccattcaaggagcggtttattacttgattcacgatatgctgattaaaggagcgctgtttatgcttgccggcacgcttatcgcattgacaggcactgccagcctgcataaaatgggcggactgatcacccgttatcccgttttaggatggatgttctttatttcagccatatctttggccggcatcccgccgttcagcggatttgtgggcaagctgaagatcgcggaaggcgggttcgataagggggaaacattgttttccgtattgattcttgtatcaagcctgcttgtgctctattcggtgctgaaggtttttacgacggctttttggggcgaagaaaaagaaatccccggcgcaggcggacggtccgcaaaaggacttctttatccggcagccgcttttctccttttgtcgcttctgttcgggctcggaaccgaatgggtttcaccgtatgtcaatcagacggctgagaatctgctgaatccggaaaaatacattgaagctgttttgaaggagtagatggcatggcttttcaactattattaaacgttcttctcgctgtttgctggatgtttctcacaaacagcctcagcacggcgggttttataaccggatttatcgcaggcttggcggcgctgttttttttccggcgcttcttctcgcggccgttttacatttggaaaatatggtcagtcatcagactggtgctgatctttataaaggaattatatttggccaatgtcagcgtgctgaaaaccgttatagcgccgaaactgaacatccgcccgggcattttcgcgtttaagacggaattgacggaggattgggagatcacgttgctctcgctgttaatcactttaacaccgggtacgctcgtgatggatatctccgatgaccggtcgattctctatatacacgccatggatattgaagatgcggagaaagcgatccacgacatccgcgtctcttttgaaaaagccattcaggaggtgagccgctgatgtttacgtttattctgcaattatcactcggcattatggcggtttcgactcttctgtacgtcattcgcgtcatgaaagggccgacgataccggaccgggtcgtcgcgcttgatgggatcggcattaatctgattgccatgaccgcgcttgtatccattctcttaaacacatcggcctttttggacatcattctgctgctcggcattttatcgtttatcggcacgattgcctttgctaagtttttggagaaaggagagattatcgaaaatgatcgaaatcgttaaatgggccgtcgccgtttgtattctgatgggatcgctgatctgcctggtcgcgtctttcggcacactcaggcttcctgatgtgtatacgcgcgcccacgcctcttcaaaaggctcgacactcggcgttaatttggtattgctcggggtgttaggctacttgtggatgctgaccggagaaatttctgtaaaaatactgctcggcatcatttttatcctgctgacggcgccggtcggagcgcacctcatatgcagggccgcgtacaattcgggagcggcgcttgataaaagaagcgttcaggatgattacaaagggatcagaaactttgtgatcaaacgaaaagaagattcatatttgtaaaaacaaacagccggacgattcagggttccggctgtttgtttattttgttataacagccagcgtacagcgggaaacacagatcagcctttctcgttcatcgaaaatgttaatcccgtacacaatggttgccctgcctgtgtgaacgggttccgctatcgccgtgaccgttccgccctctttcactgactttaaatgattggcattaatctcaagcccgacacacgcctgtttcgaccggtcgataaaatgctgggccccgacacttgcagcagtctccgccagcgctgctgacgcgcccccatgcagatatccgaaaggctgcaccgtcctcttatccaccggcatcaccgccacgcatctctccggcgtgttttcagtgatttcaataccgagtgcgccgagcaatgtattgttcagattcataggtcattctcccttcaagatttatagtacgttatctgacttggcgatcagcaccgcttcagttcgggagccgacattcagcttattaaaaatggatgtcaggctgtattcaatcgaccgcttgcttaagtgaagcgcatctgcgatttcctgattggtcaaacctttttcgacctcttggagaatatggcgctctctcggggttaaccgatcctgctcactttgaggggaagaagacgtttttgttttttgctgggtcatcagctgtttgaaataggagaaatcaactaaaatctgtccgttgagcacgtgatatatgtattgcatgattttctctttagattcggttttgctgatggcgccatgcaggcccgcgcggatggattcttcaaaataatcttcaacctcatagcctgtgtagacaatgattttacagagaggattctcttttaagattttcttggaaagctcgatgccgctgatgtcatcacccagatttaaatccattaatatgagatcgtaagctgaaaaatcatgccggagaacgaattgttcactggcatcaggactgaggcaatcgacagaaagattcgtgtccgtttccagaatcgtcttggtgccctccatgacagccggatgatcatcaatcactagtatctttttcatggtttcctcccttttactcactcatttccattttattaaaaagacttggcttctgccaagtcgatttggtgataaaatggttacaattccatttcaatatccgctttaaaaccgtttccttcacttgtgtcgattttcatccgtccgtcaagcgcacggacgcgctccttaatacccgaaagacccatgctcatcgactgtccgccgccttcttcctgattgcagccgacaccgtcgtcttcataatgcagaatcactttattttgaatgctgatcagcataatcagcacctcattcgcctgtgaatgcttcatggcgttcgaaagaaattcctgaataatgcggtacaaattcagctgcgtatccaaatccagcgccgccgtaaaccggcccgtattcagacggatatgaaacggcgcacgctcttgctgctgcgcggcaagcttggataccgccttgaccagacccaaatcatacagcagctgaggccgaagctcatggcacgtctcccgggtcatcaaaatgacatccgacatctgctcattcatctgatgaagcttgtcctgcacctctaactggcaaggctcctctttcttaaaatcggccagaaacagctcacactggcgcttcaaagaaatcaaatcctgcagcactgaatcatgcagatcacgggccaaatccgaacgctgcttttcctcgatcgtaaacatcagctttttgagccagaccgggtttgagccttgttgtttcaggtcttgtaaatggttcatgagttcttcgatctgcaatatgttttccatcgaaacacttgtataaaaagacaatgtctttaaccaagatatctcatctcttgtcagtctcggagtattaatgctcgacaaacaaagcagaacgtatgagtttgcccctctttctccaatcttcatcagaaaaccttgatttacttcaaaaatcttgccaatctctgatgagactttaacaaattcttttttatacggctgccagttcggttcactgttctgtttatcaaaatacagaatatctccgtcagaactgatttcaaagatatatgccttactgacaggcaacacatctaatatcgtctttttaagattcataaacacttggtttaaagctgatacgcttttaagaagctgtgtatatttaaatatgctgtcttgataattatatttttctgaaaaacgtttcaggcgaaatttgtagtctaataactccttaatataaaataccgctaaaaaaatcaaaaatacatatacagtgatttgaataatgttaaagttattccccttgctgtcgaataatatattcagccatacaactccaatagtcggaataatggaaaggaaaccatagtatctaattctgcccaacaagaagtctatatcgtagattttattgaccacgaattgatagactaaagctaatggaataattattaaaaatggtgccgtaactatagcagaataaatatactgtccgaacaacacctcaggtataatataaaatactgtaaacggaaaaaaggctatggtattagatataagtaatactttcagcaaataaaagtgatccttttttcggtagactagtccataaaaaataatggatgtatagacgaccatcatttccaaaaaaaatgttactaaattaatattcgtaacaagttggaaggcaaaatgcttctggaatatctcgattattatattaataaccggcaatatatagagagtagacacaacataaccagctgaaaatttcaattttaattctttaaagtattgatacaaaaagtgaaagtataatacaggtacgttcaaaaatgtaaaaaggttaatatatctgtttatttcatatcctctagttactccacctgcgcttaaatatgcaatggatgtacacaataaaaaaataatcaaaataaaggctgaataagtatcttttactctgttaactttataaatataaaaaatgcataacatgcttaaagcaaataatatgcatgggataatatagataaaaaaactataagagctatttaaggaaataaactcagtattatgtaagtctattttactattaccccttattattttcatatgttcagctttcgctagatattgacctcttatattctcttctgtcggtgtttttccgcttatttcaattatcctgtctccctcttttaagcccatatatttaccatacgtagacttggagagttttacaacctgcaattcatggttattgttttcaaccacataggttcctaccaaaattccgttttgagtaaaatatataatatgagcgacgtaaaagagactgacgaataacaatacaatcgaaaaatttctaatgaattttttcaatagatctcactctctcaatcattgttcccaaaaaattcccctgcatttttttgattgacttaagtccctttcaaaaatctcaacaatggcaggtaacagtttatccggaactcctattaaactagcttccccacacgctaactttgtaagtacaagtggattttccataagataatgtacgatatcttgcttcactgtaatttcctccattaaagttctaacattatatttaaatcttttatacttgtcgtaatttcttcctcgtacattttaattaacattgaaacatactggctaactcctgcatcaaatagtaggtcttcaaggctttttttattatcaatgaggaatgaatggtaacttgcttctgcattcattaaatccaagattttttctgaagcagcattaaatcttcgctttagatacaacagaattaatgtttttcttccctttctgatatcactacgatttttattaaaaagaccataataatcattttcaatctgtttaacaattccaattttataggaataattctcaatttcttcgttaaactccccatttgcaagcattgttcctaatacagctgacattgcagtaagcgagcctgatttttgtttaatcatttgaagacattcgtcttcagtttcggggaaattttcgaggtcattatgctgaccttgcattgcatttaaagcatatttcatagcaagccggggaaaatcggagttcgttttaagctcacaaatcacttgaagacttattgaataaagagaagtggctgcatttaaagagatagattgatctatcttcatccattccttatccaagttatcttcatcctctatatcgtcaaaaatatcaaaagctaaaattaacaattcaattcctgaagctaataacgtaatatccgaataatgctcaccatcgaaagccacataatgcttaaatgcaagaacaccaaaagcaaaatgatttttttcatttataaaagtctgaagggtgtcttttaaatgtggattatttattttctcctccacaatttccttcatcttctctttaatcgtttcggcatctaaacacatttgctcaataattgtcttcaccctcccattctattttactaaatgcaggtgatgaaagacagcaggtttttcgttttttaacaatcgtataatactttatccatgaaatggataaaaaatgcacaaaaaaaagacttgtttccaagtctttttaagaaattttcattgcatatgagaatttatcgagctgatcaatgcttttgttaatgtttcgtaatgagtcggttgtttctctgatatcattttcaagtcggaataataattgctttacttcttctaatttgttttccaccgtttccacactcctttttttgaaagatcaatgaattgtgtatggtgaacgagtcctaggtatttgatctgttactaatagtgtaaacgtttttgcgggatttttcaccgaaaagtatgtgtaaaagtatctgcgtgacaccgcaaaccaaggtaattccatagtcccgaacagggcatttagcgaacaggactatataactaccgcaaaggcagacgtttaggataaagcagaccaatctggcggttctgctgttttttcaacggttttccgacaaaccggcagggactatagtccctgccgtcacaatttcaaaacagaatgggcaaacagcgtcgcataaccaccgacaaacaccgaaaagaccgcaacccccgcattgtggtctttttgcatgtcataactcattatcacgccgcctatactcatgtataacgaatgttttctcaggaaggaggccgccgtatgcattatgtgtatccatgctgccctgttttcgccgcgccataccggcatccagcgcccagtgccccggttcacgcagatattttgacagcgtccgcaaaagaagctgcgggcatgctggaggatgcgcgcctgctccttgcgcggctgtcggcgtcaaaagagcttgcgcgcagcatcctcaccgcagcgcaatcatctgacaccgcagcggtcaagcggctcattaagcagaccggcatcaaaaatgactttgacgtgacgtataatcccgacggcatccgtgtcagtctgatcagagagcaaagccggtttatcatcgccctcagatggtcggcttaaagcggctcaatcgatcagctgccggcaccattcgatcgcctgtaagtaacattcatacgcttcttctttgttcagttcttttccccactcgtcacagtcccagttgttgcattcaatggctttgacgagcgcgagcatcttataataatcgttttcataaccgagcagcgcctgtccgacttcatcgattaaaggcagttctttgatgatatcctccagttccctgtggagaagcgtatcgatgagcgaaaacatgccgatcagcatgtaagaagagggctggggccttccggttcttttcgccagcagttcgcacagtttggccctgattaaggaaatcttaatgatttctttttggcttgagtggcttttcgccgttaaatctctgaatgaaagaatgtaaatcaagcgcttaatctcattcagcccgagcatcatgatggcctgctggatgctgtctatcttttttttcagtcttgtttgcgatccgtttaaaaaacgcagaatctgatacgataagctgacgtcacgctctatgtattccgtcacgcgctgtatattaggctggtcattgtttaattcgcttaaaagctggtagtaagaatgaaaatgaaacgtcagatcatttccgctgatgacacgcggttcactgaaaaaatatccttgaaacaggtgaaagccgtctatggccgcctgtttataatcttttctcgtctccactttctccgctaaataaatcagacttttacagctgtacgtctgaatgatttttttgcgctccagacgcgaggattgcaaaaagtcgatttttaaaatatcaatatatttcatcagctgttccactaactcttcattttccggattgatggcgtaaaaatcatcaagtgctaatgtatatcctaatttcttcagctgtctgcatcttgagatgagcgccggagtgatcggtatgtcctcaagaatttcgataataagctggtcaggatcaaaggaggtagggagatctgaaaacatcaggctttctgtaaaattcacaaagcagcgtttcccctcagtcagcttttcgattccgatgttgataaagctgttaataatgagatccgtcgtagctttatctccatccgcggccgaataacggttctcttcgctctcccggtaaagaagttcataagcaacaacctgttcgtttctgttgaagataggctgtctcgcaacaaacaccttcattcatttacccccttagatgcggccttcgaacataagtatatcaaataacttgacgaaatttgtctaaatgtgaaaaatattatcacaacaaaaaagcctttccagagataggaaaggccgctttgttttctattcaagttcccgtttcagcttgcttttgatttcatgaatccgctgcatcttgttgctccagcagtcttcgcttaaatcgaccggatattcttccggcttgctgatccgtttgtattcctcccacagaagtttgaggttatcctgcacgtattgctggatgtcggtaatttcgggattatcatagcataaaacgccgttttcaaagatcggctcatgcaagtctttcgcatagaagtcagtgacgaatttgctgacgaacgtgtggacgggatggaacatttttaagcgtttctgatcatttacccgctcgtcataaagcgcgatataatcaccttccgagtggtgattcagcttgttgataatccggtatactctctttcttcccggcgttgtcactttttcagggtttgacgaaattttaatggtgtcggtcagtttgccgtcctcttcaatggcgacaagcttataaaccgcgccgagagccggctgatcgtatgcggtaatcagcttcgtgccgatgccccacgtatcgattttcgctccttgggatttcaggtttaatatcgtgtgctcatcaagatcgcttgaagcaatgacctttgcgtctgtgaaacccgcttcatcaagcatttcacgcgctttttttgacaggtacgccaagtccccgctgtccaggcggatgccgatgaagttgatccggtcgccgaattcctttgcgactttaatcgcattcggcatgcctgaacggatcgtatcgtacgtatctacgagaaatacgcagtctttgtgggtctccgcatatttcttaaatgccgtatattcatcgcggtacgcttgtacgagcgcatgagcgtgcgtgccggataccggtatattaaaacgctttccggctcttacattactcgtcgcgctgaagccgccgatcaaagccgctctcgctccccacatggccgcatccatttcatgggcgcgccgcgttccgaattcgagggcgtcttcatcaccgacaacgcctttaatgcgggccgctttcgtggcgattaatgtttggtaattcacaatgttaagcagagccgtctcaatcagctgcgcttcaatcaggggtgcttcgacccgcataatcggttcattgttaaaaacgagctcgccttctttcatgctgtaaagagatccggtaaaagaaagatcccgtaaataatcaatgaaatcatcagcatagtgcaattccgtttttaaataattcagatcgctgtcggtaaatttgaagttctccaagtattcgattgctttttctaagcccgcaaataccgcatagccgttttcaaagggaagctttctgaaaaaaagctcaaaaatcgcttttttctcatgaatgccgtctctccagtacgtttcggccatattaatttgataaaggtctgtatgtaaagacaaactgtcgtctttaaaaccatgctccaccaaaattgttttccccttccttactctgccacttgcgctccgatgctgttcttaaaatgggacagggcccattcatgcccttccggattaaagctggccacagcgttttgatgaatgacgatctgaaagcccttgttgtaggcgtcaaccgccgtgtgaagaacgcagatgtcggtgcacaggcccgcaagatgcagctcagtgatctgccgttcccgcagtttcagctctaaatccgttcccgcaaaagcagaatatctcgttttttccatataatttacgttttttgcgtgtttatgtttctcataaagaggcgatagccttccgtacagctctttgccctccgtgccgttgatattatgcggaggaaacaggcgtgtctcgggatgaaagtcatcgtctgcatcatgcgaatctaccgcaaagacaacgtaatcaccgttttctataaatgcttgcgtcaaactgacaatcgtatcttcaatctgtctcgcgggttctccgcaggttaatgccccgttctcagctgcaaaatcattcgtataatcaatgcatataaatgcttttttcatagccggcctccccgccattcatatgaaaaccattatatcctatctccacttgtaagtgaattggcattgtaaaatgacaaacagtgttttgcccttttaagatttcaggagtgagcgctgaaaaatgtcatcctgcacgtaaatgccgtcaaggttcacggcataatcggcggcaaaaaccaggccgagcggcgtttcgaattgaaggtccgagatgacggagcttcggacaccggcaagtgcggcaagcttcatatatggtgaataagcatgatacgggagccttccgtttatatagagcaccgcgtcttttcggcttttcagcgcctgtttcacttcttcatacggctgcttttgcagcacctgtcccttcgtcagggcaatgatgactctttcacgcagcgagcctaaaaataaatggcgttcatccggtttcgtctgcaaagggccgtacatcccctgctgtaaataaaggtcaaccgttttgtcgctcatcggcctgtccctcccagcttgttttacaattatcgccccggacgggacgcggtaaaccgttttcgttacatttcagccacccaatgggagatcttgccggcgagctctccggcgggttcttcttcaatcagcttgctgaatgattgtaaaagccgctgcgccagcgcctttttctcttcctcataggaaatgatcgtgctccactcaagttccggaacggctacaagggtatgctgttcttttttattttcatgcagatatacatcaccgatcattccggactgcacggtaatattcgcttttctgattttcataaaacattccccttttataaagactgattctattatactacaaaaaagcgacagcctcctaaaaggaggctgtcacgcgttaaaccaatcaggttcgtcaaacacatcaatgtcttcaaagcgcgttttgctgaatttattagtaattttgacaaaatctccggaatgaaacgcccctgcccccgcgcctgagtggtcaacggctttgggagaaatggcaaacacgtcaccgaagctcgctgcagcgtctccggctaaactcataatataaatcggtcccacaattgcaggcatacccacacctccgcttttctttacagcattttatgcgctgcaccgggagttgtgcccgtttttatttcggcttgcggctgtcttcgagctttgaccgctgacgaagtttgataagccggacgatatttaagacgaaagcttttaaaaccgcgtaaaccggcacggccaggatcattgcgagaatgccgccgaaactgcccgctccgataagcagaagaataatggtgagcgggtgggtattcagccgttttccaatcacaagcggagaaagcaggttcccgtcaagctgctggacgacaacgacaacaataacggcaaacagcgccttagccggcgaatccataaacgcaataatcaccgcgggcgccgccccgagaaacggccccaggtacggaatgatattggtgacggcgatcaccatcccgagaattaacgcatacggcaggccgatgatccaatatccgataaaacatgccgttccgacaaagagacaaatcagcagctggccttggaaataggcggccaatgtgacatataagtcgttaaatattttccgaccttccgcccggtaggaagaaggcagaattttgaccgccaagagcggaaaccgccggccgtccttcagcatataaaacaaaatgaacggaacggtgatcacgacaagcgtgatattcgtaacgacgccgaacacggccgacaggcttgccgtaatattttgcggaaggctttgtaaaaatcccgtcagagactgctggattttttctatcgacacataatcctgcgtcatcatccacgtaaaccatttggaatgggataattgcgccgtcaagacttgaatctgatgaatgtaatcagggaaattgttaatcagccccgtgacctgggaagccacaatcggcccgatggcagtgaacataaaggcaatcagaccgatgaaaacgagataaatgagcaggatcgccaatgtccgggggatttttttctcaagcaggcgcacgatcggattaaaaatgaaaaacaaaatgcccgagatcaaaatcggaaaaaacagagtggtgataaaaccgaaaaacggctgaaatataaacgagactttcgttgatacgtaaataatgagcaaaacgagcaaaatttgcagcgtccaaaaatggacctttgatttcaacaagcggtttcctcctattgtcgtgtgaacttgtactgtgattgtaccaaaaaaagccgccgtgcatctatgtatctcaaaaaagaagacgcaccggggttctatagtgccgcctccggtttgcgccttttcgggctgttacacgcgttcggtataatcaggcatgacggaaaccacatggcggtttctgatataaaatacacggtcatgcgtctcttcaatggcgatgtgatccggagtggcatcaatcagccgtcctctgacaatgcgtctgacggtttgaatgataaaccttgagccgataagcttatggatggtctgataaacgtaaggatccactaacgagacgatttgcgggcttccttgatgggccattttcgctgatcccctttactatgttttccttcagcatatgcagcggacaaaggctttgacacagtacgtctatcggagcggaaaaggtgttagtgagcatgcggagttatgtaagcggaaaaggccgcatgagtggcctagactgagcttcttatgggatattgggctcggtcaattaactgatcaagcttttggatttgtttgagcgcggccgtgtgatccatttggcggtaatggtgatgtccgccgggttcttcatcgagttcatccgcttgtttcacgatttgctggagcgtattcttgtccagttcgccttcaggcagataggaatcggtgtgaagcagaatcgccagcgcaatgtccttcgccgctttcggttcttcaccgagccggatgagcagcttatgcgcccgttccgcgcctttaatggcatggatatcatttcttctgtacttttcataatcccatttgccgtctgtgtaccattcataatggccgacgtcatgcagtaatgccgctttcgccgccagatccgggctgacacctgcttttacggcaagacggtatgcatgaaacgcgcaggcgatcgcatgggcgacaccggaacgctgtaaatacttttgtgcgattggatgggtgaagacatccattaacgttacatttctcatggaaacccctccttcatatatttttagaatcctaacataaatcgagaagaaactcaattcatctgatacatttcttataccccttatatgttgtttcattcatcatatgccgccggacccctaagtgattgtacaaacaaaaaaagagcagcgtgaaagctgctctacaaaaattctttgatatcgtatatccgtccgttttccggctcgcccgcgatcagtgagtgaatgacgccggcgatgtattcaggacttctgaggtttttcgtttctttcagattgcggaaccgttcgatgtcatggaaatcttcttttgacgaagaacggatgaccgactgcatgtctgtatccatcactcccggcgagaatgatatcatgcggaccggcagctcttcatcttcctgttcaaacccgaatgttctcgtaaacatatcaagccccgcttttgagctgcaatacgcgctccagcctttataaggatttttcgccgcgcccgatgtgatgttgacaattgttttgctgccgctgaacgcttcgaagcgctttgtgaacatttggctgagcaaaacgggcgccgtcaggttaagggtgtaatggcggttcaattcttcggcggaagcctctttcgcccgcttgatcggttccaccattccggcattgttgatcagtgtgacggcggagtaccccttctcctctgcttgatcaagaatcgccttcatctgccgcccggtatctgcgagatcggttaaatcaacactgtattctgtcagcccctcgcgcttttccccgcttatcgttcttgaaagcgcggcgacttcggctccttcttgaagcgcctgttccgtaagcgcccggcccaagccttttgacgcgcctgttataagaaaaaactgcatgaaactcctcctttttttcttattttacgggctgtcttcccgcaaacacaagcgatccgttttaccgctttgccttttcctgcgccgtgactttcgggatcagatagatcattgccgcaatcccgaggaggatcaagacggcataaatagcgggaagcagataagaagtctttttctcttccgtttccatatctgccgaggtatgccgcaccgccggctcggcaaatgtgatacccagttgtttcgattgcgctttgatcgtattcggctccgtgtctgacgatgtaaacaaatttgatatcagtttgtcatccgggttttcggccggctgatcaaacgtgatatccttctgttctttcggaagcgccgttttttcctcggagtaggcatcgtcgtgcaggtagtccgtacgaatttcaatgtctttcttttcatattcattcggcttgacatcagtattttcctcattcgcggctgcggcttggggaaggaaaaggaaaaaggagagagcaaacagcagcaatcctttttccatgaacgtgttacgcctcataagactgatcactttcctccgttttttccgcaaacagccgaatgacgagcggaagcgccgccgcaatcagcgtaatgatcgcaagaaccgttacccccaacgcaaacagatggcccgttccgtattgaatatcgatatagactttcgaaaccggactgtcaaaggtgaagttcggcataatcaggtcgatcaaaggcgccacataaaagagaatgagcgctgatgatgcgatccatccggtaattgagctgaagacaaaggctgcccggataaaagctgaactcgccgcaagcaggagaatcgtaaagactgaccatttaatcgtctgatcatccggaagcgaatagatattcagaccgaacagactgatcatcaatccgaccataatgtttaaaatcccaaagagcgcgcctttgacaagaagcggcgcctgctgataatacgagctgaaatagccgatcagaagactgctgatcaggacgatcaccaaaatgacgaccggcggaacattctgaacccggtcttccggcacctctccgctgattttaagcggattggcgagataatcataaacatatccgttttcctgtccgtcaacgagcgcgttccctaaaatgccgtacacgtcatttctgatcaatttcgtggaatcgacgtttttgccccagttgctgttcagggtgtccgctttttgctggacgtcatttacgctttgctgcatattgtcggtatagctgatgatgccggactggcgttctgacagatggcccatcgtgtcagacatttgcaggacttcacggccgacggtatcctgagcgccgagcgccatcgttccggttaatccgtctccgctgaacgcggccgcttcctgcacagcgccttcagccagctgatcggatgctttcgccgcgctgtctgaaatgctggcaagctcatcgagcaccccggcttgctcatctctgatatacgagctgtagttatccgagaattcggtcatgcctttaatgaaattgctgatgtcttcatcagtctgcattttgttgtttttcagattttcccagcttgccgtttcttccggtttgatggcaagaacggtttggacttcaccttgctgggctttcagcacccggtttttcacatcaggcagcgagcccgcgtcaagagagtgatagagtgtcgcctcatacagggataaatcattatagtaactcattaaatcggatatcttttttgtattgatgtcagcggcaaacatctgttcaagagcagatttgcggccgctatccaatgacgggtagttcagaatgttctgttctgttcttacaatcattctgtaaacggtatcgaagtcttgttttctcgtttcttccaattcttccaaattttcctttaatttatctgcccgtttttcaactttggcaatctgatttttaaggccttggatttcttcatcaagagcatcgagacgttttttcagttctttattatgagtctgctgtttctcttccagctctttttcaatttgctgaatgcgttctgcggcttggttcagcctttcttttgcctcagatatgtccgtgccgccgtccctttcagaatcgtttggatcgtccgccggctcatcagcaggcggagtgacgttttcagcggctgtcgaggtctggacggtttttggctcctgatcgcctgtgttatcggaggcaggctgctcttcttttgtgccgtcttccgtttttccgtcttctccgggagccgttccgttattcggatcggtatcgccggagttttcaccgtcatcgccttggcccggttcttccggttccggtttttctttttccggttcttttaatccgtcagaaatgtgattgatttcagcggagatgcgttttaattcgtcacgctgatcgtcaaggtcaattttcagatcgccgggtttttcttcttccggtttttcttcttctttcggttcatccgagccgtcatcacccgggtccttttccggaacggttaatgccggccgatcccttttcataagggtttgaatgctgttcaatgtttcaaatcttgcttgcgctttatattgagtcaaataattgtccagtaaattggattgaatattcgccatcccgcgttcctgatcaggaacctgcgcttctctcacctgttgggcggcaaaaagagccgatcccgtctggtcaagctgtgtctgcgcccggtttatgcctgaagagagcccgctcatcatcgtgctgaactggttggcggcctgctgtgctttaatggcgttcagtccggttgtgatttgcttttgattttgttcctgcgcggccatcagcagttttttctgattttcttgatattgtttgtagcgctcgaccgtgtcggcaaagtctttgagcgtggttttggcttcatctgccgaagtcagtttttcttttgccgcgccctgcgcttcattcattgattttttcagttcgtcaatcaggtctttttgccgtttgatttcacctgccaagtcattggagctcggcttgtaaaagttgtacatgacattttgaaactctgattctttattgacgatcttgtcaaaatcgcctcggacattgttcactttttgtgagacgaaattccaatataatgccgacatttttttattcattgatttttgggcgtcttcaagctcacgctgcactttttctttgttgacggcgttcaggttgctttgaatattgaatgtcagcgtggctttttgcggacgctccttgtcatagcttaagatgtcttttgaaaaatcggatggaatgtaaacgacggcgtcatatttcttagccgccagaccgttttctgccgcgctcctgttgacaaccgtccatgaataatccggacggccgccgagagcggccgctacttctttgccgaaatggacggattcctcttcctcattttcatctgtttgtaagcccatatcttcattcacgactgcgatttggcgggtggcgttgattttttgttttcccgggtcatcgccgataaaccggaaaaacagcaccggcagcagcagaatgatgacgaccgcggctattaatttgatcaggctttttcgttgttcggtcatctgacggcctccctttccgctgaacataaaggtatttggattttttgctccttcccgttttcaaccaaatagccgaagcccggctgaatgtccggttcctgcctttggtaaggcagcggaatgacattttgttcggattttttcacaagcagcatcgcgtggcggatctgtttcatttccgtcgttaaggaatcatagccttttgagaattcgctgtgattgcccgccgggataaaactgaagcccacatgcgcgtaagatttcataaacatcgccagcttgtcctgtaaggcggtgtcgatcgtctgctggaatcttgtaatgccgtcggccattaacacgaccggagagaaactgagtttgtgcacatcgccatttttgacggcctgcgtatactgagcttcgcgctccgtgaaaatggcttctgccgtttcgatccactgccggacgtcttcttttgtgtccagatagctgacctttgtttcctgcgcatactgcgacagtccgcggtcaatcgagtcaaacagcccgacccgttccgcaccttcacgcagcaggtgattcagcatcactttcaggatatttgtttttccacgctgtgtctggcccaaaataagacaatgcttatttttacccagatcaaagtacacagggctgaccttttcctcatgaagcccgacaggaatgcggaacgggtcttgttccgggccgagacggagtgaaaattcgccggccgtcagcatatccggaagcatcggaatcgggtctggtccggctgttccggcgtggcgctcagctaaagctttgacatcagctttcagcgcctggaacatctcgaggtcattttccgcttcagccggaagaaacatttgcgcgaaatacagttcttctttttggatcatgacgcggcccgggatcggttcgagactgaacggcggacgcccgtaaatggagtatccttctgactgatccattaaataatggacgactttcgtttttatgttgtttaacagcgactggcggacggcgtttaccctcgttgcggtcagcaggaagtaaatgcctaagctttgcccgtcgcgtgaaatctggataaattccgtttctaattcatgcatttcgtctttgacgatgtcgaaattgtcaattgtgataaatataaacggcagctcttcttcactgagcgaattgtacattttgatatggctgacttctttttccctgaacagccgtttccgccgctcgatttcttccttgatgcggatcatgaatttttcgatctttctcatttgatccattaagaaatagtctgcggtgtgcggaagctttgccaatggcagaagcgtgccgtttccgaagtcaaagatgtacatatgaagctcttccggcgtgtatccttccgcgaaattcatcaggaaggtgatggcagccactgacttgccgtagccggatgagccgaaaatgccgatgttgccgtcatccatcattgtgtaagcgagaggcgcctgtctttgctgatcaggctcatcaacgcaggcgatgaagaagcggtctttttcctgcgcggggtaaagcgtgcgcgggatacgttcggcaagcggcggaagccacgggctcggcagcttttcaatgcccatttcattttgaatccgctcgatttcttcgactacggcttctatttctgccggggcgtcttttttcgccgcatcatccgcatccacctcagacagcggaattaagccggtatcggtaacgatggcaatgtcatcctcggtgccgtatacatcttccatgtaaggggcgccgctccaggcagactgaaactgctcatacacttcgttatttccgacttgcaagtagccgcgtccggtgaccgtaatattcgccgcatcactgtttttcaggatttctttactgtcacttgcatcctgcactttcagcgcgaccttaaagcgtgagttgctccatatttggtcgtcaatgatgccgcccggcttttgcgtggcgagaattaaatgcacaccaaggctccgtccgatgcgggccgcgctgacaagctccctgataaagtcaggctcttcgcttttcagctcggcgaattcatctgaaatcaaaaacaggtgcggcatcggaatatccgtttctccctgtttatacagttttgtatagtcattgatgtgattgacgcgatattgatcaaacagccgctgccgttttttcagctcgctcttaatggatgcaagcgccctgatactgaagtttctgcttccttcaatattcgtgatggtcccgagaaggtgcggcattttgcggaacggctgcgccattcctccgcccttatagtcaatcagcaaaaacgccgcttcatgcgggtgaaagtgaacggccaatgacaggatatatgtttgcagaaattcacttttcccggagccggtcgttcccgccagcaatccgtgcggcccgtgcgctttttcatgcaggtttaaatagacgatgtcgtcttttcctttatagccgatcggaacagccagcgattttgcagactcacttgtctcccacttctgcctgatgccgatttcttttacttccttcgcatgaaacagctcgagaaatgagaccgtttcaggaatggaattcgtcattccgacctgatggtgcaatgtccgaagcgtccgggaaaaccgctcgttgtttgtccgttcatgcctgtccagcttaaacgggatctgcaccgcttttttctgttgaatgagaatgtctccctcatcttcattaatgtagcggacgagggtgtgaatgttttctgccaggctttcctttgtttccgcggcaatgatggccgagatgccgagatgctcatgccggccttcgatgtattctaaaatgacgtgctctgcgatcagctgctgatttgtgatgacaaagacaaaatgcggctgaaagatctttttttctttatcctcttccaaatcccgctcccgcagcagctcgtaaatggacgataacaattgatcgcgggtctgttcattgtaaataaatcctttcgcatacatatgaggcagctgaaattgcggcagccacttcatccattcccattccttatattcgtcctcatgaaagataaagacaaatcgcaggtcatggtagctgttgaagaacgcgagctggccgatcagctggtgaatttcatttttgacgatctgaggtttcccgacaagccccatcggcccttcttgtaaatcaacggtcacgggcgcatggcggatgtctttatacacacgctgcatgtgctgcgactgctccatcaagtcatccacatcacggttcgccaggtctccgccgctcattgaaatctcgtagcttgacgggaccgtgcccgttccgagccgaagcatcagaaaatccctgctttccagcgatttctcccaaatgcggccgctgatttcagaagttaaatatttcattttttcaaacgggggaaaatgatgcgtcagcacgtgcagctgtttttccgacagcgtctgaagctctttccgtttgctttctaaatactgcttgtacacacgctcccgtttttcctcccgttttttccgctggtttttttcacggaaatactgcacggtggacgtaatgagagtcatcataaacatcgccaaagagacaaggatgaatatgcccctcggctgtataatagcgacaacccccattacaatcagcatgaccacaggaggcagaatgacgagccacagcccccggttattctgttcgctttcctgcgagggaaagctgaatgaaacgcggtcttcgggaagatcgtagaccatgcgcggcgttcttcgatattgcgggtatttctttttcatttcggtgcttggttttaccgttttggttaaaccggcttgaagcttttcgtgatgaacgatttctaaaaggtcgtcctccgtcagcctcacacgcagaaaattccacagcagctcatctcccgtccggagcctttcgggagcttctgcaagctttccgttcacataaacttcctgaccatcagggacgacagaccagcatcctcccgacttacgcagataaaaagcccctgtttgagcggaggacggctctttgtatatatccgcttcctctgtttctgatgagaaaacgatctcatccttcccgccgataaagtacacggaggattcttcctggtcaggggtgagcagaagccgcatcgtctcttcttcaatccggcagggcatttcatttcctattgtcaattcgccggcacagttatttcccaggaaaacatcataacgatctgtttctttccgataaagggttgcggcgttttgccgtaacggaagtgtgccgaccgtgattgtatctttcatatccggaccgatcgtaatcggctgagagggcgggagttcagacagctgaaccttttgtacgtgctctcggtaaaagacccataacagactcatatggcgaacctcctgacgacagcctgatcgttacatgcggccatttgatgtgtgctgttattttttttcatcttttttctcatctttcttgtcgttctctttgttatctttcgctttgtcttgtttgctttcatcttgtccggcggaagcttcggcggtgtcactgttttcctccgcttctttatgctgttcctccgcctcttttttcgccttcgcaagctcgctttccacggcgtccagttctttctgcttttcgtcgtctttcatactgtcatccgctaataattgctgtttatattttgtaagtccgagccagatgtacgggttgtactcaagattgcggccgattttgatggcttcttcattttcccctctgccgatatcaatccaataaaggaagtgcttcgggtctgattgcagcgtgaccagattcccgatgtttttccgctgttcttccctcagattttcaactgccacataagaggaagcaagctcgtactgcacagattccgggaggctttccgcatcgtatttagcgagtgtgtcaatgactttgctgtactgctgatttaaaaaatagcggttgctttccgtaattgcctcttgcttcggctggacgaaaaacagaacgtataaggagtaaagaagtgccggcacaaggaggacggcaagcgccagaccggcgtatctttggattttccatttctttttcggcagttttatgtatgtcttgtccctttcttcgagggaatcgattgcggtttgaatggcttcttccagttcttcaatcgtctccgcctctaacacgcttttcacctcaggagagaaatgaagcgtctccttgtacttcaaatattcatcgaaggtgtacgccccgtcagctgcaagcgccgcacaggctttgagctcttttaacaccctttctctatcttcctcataaggcggaaggctctcctttacgccgtaatgaagaaagtaaggcgtcagcgctttatcaaacacgatattttcaggggcggcaatcagattgagacgtttcagcttatgctgtttcacggcttggacgagacggtaggcaaattgccacctgctttttttatcttttccttttatatagcggaaagcctgataagaagaaggaggtttgattgtgatggttacttcgtcttctgaaactgagacctctttttgaaaaaaaggatcggcatctttaatcacattcgcttccagcccgtcaagaagcttgattttttcccgctggaaggtgaacgtgaagcctgattcggtttcttcccggacggcgtctaattctgtttctaaataagatctgttatgacctgtcattccaccatgtcctttcataaaatttcaaggcggtctccgttcgtaatgccgcagtcagatagcttttgttctccggaaaaaaccgtttctttattgaccactctgatccaatagccttcacgcggcggaacggatacatgctgagcctgccgggcaatatcaatgacttttttcacagaatggtaatctgacaatctgagatcgaagacgctgccgttataatgtgttaaatctattgtaatatcgatatacatattcatatcacccttacatagaaagagcgccgtcttcttgattgaatcaggcgctccgtttcttcattcatcttattatccgcgaatttggttagcgatatcttggtcggtagactcaagcgtatttgccgtttgatcgagctgatgattcacatcttgaagcaattcagacattttaataaatgaaggtttcagctgctcatattgatccgcgaatgcttcacttgaagcaccttcccacatgcctttcaaatcagaaatcatgcggttcaggcggtcaacctgattcatgacttcctgactttcaacgccatattgcttagccatcgctcttagctcttcgggtgtgacacgaattaatccagacatattccttataccctcctgtgtcatcagcctaaatatgggctaattcacttattttttgaacgtcattattataaaaacaaccaatcggcacagtcaaacaaatctgttttaattttacaaaatgagtcttatgatatattggatttttcgtcataattacacattttgtaaataaaatagtatgattttcttattattttcgttttcactgaatgatcttattgtcctagtctatttccctgcaaagatgcctttcagtctgaaaagcaagatggtaagatcaagatatgaagctatgaaaaagtagggatacagatgaccaatccaaaagatccatttaagtacagtttcgacaggcttgaagatgttgccgaccatatcagtgaagttcttcaatgccccattacaatagaagacgttaatcataaactgcttgcatacagcacgcacagcgattgtacagatcctgcccggacgtcgacgattatcgggcggagggtgccggaaaaagtcatcaacaaactgtggaaagacggaaccattccggcccttttaaaaacggaccagccgatcaaagtgaaagaaattgacgaggtgggcctaagcaaccgcgtggcgatttccatctggaaaaacagtcaggttctcggatttatttgggcgcttgagatcaaaaaaaagctcaatgacgaagatctgaagacacttcagctggcagccaaagcggtgcggaacaagcttttgcacctgcagatccgcaaaacgaaaatcgaagagcggggccaggagtttttttggaaaatgctgaccggccatatttatcaggaagccgagatggccgaagggtttcataagctcggaatggcgctgccgtccgtgttcagcgtcatgatcatccgtttacatgatgagctgactgaaaagacggaacagcagctgcaatatttgcaggaaacgacacagcagattcatgtcatgctggcgactgttgattcaaatgaattaatcttattagccgcgccgaaaaccgatcagccttttaaagatttaaagcacttcgctcttcatattcaaaaacagttgaaggaacgatataaaattgaggatgcgtcgattgcgatcggcggtatttacgaatcgatttcttacgtttaccgatcctatcaggaagcgctttccgtattaaaagcgaaagagcggtttgtgagagaaaccaaacaccttttcagcttttctgaactcggcatttatcagtaccttgatgtgttggatgaaaaacgcaagcacagcggctatatgaactattccctgtcaaagcttgagcagtatgacagggagcaccaagccgatatggtaaaaacgctcgaacattttattgatgccgacagcaatgtcaacaccgccgctaaagcgcttaacatccatgtcaatacattgaattacaggctgaaaagaatcagccagatcgcagaaatcgacttaaaaaatgtgaatgagaagtttacgatttacctggatatcaaacttcgcagcatgggttcgtgaaatttcacaaatccgtgtttttttattttctgtttcaaacaaagaattttcgcaaaaatcgcgctacacttgaagcatcacacaaacattgggggaaacagacatgattatcggggttccaaaagaaatcaaaaacaatgaaaatcgagtggcattaacacctggaggcgtttcacagcttatcggaaacggccatcgggttcttgtggaatccggagcgggactcggaagcggctttacaaatgaagattatgtatcagcaggggcggaaattctggaggacagaaagcaagtatgggatgcggaaatggtcatgaaggtaaaagaaccgctggctgaagagtatgcgtatttccgtcaaggtctggtcttgttcacttaccttcatttagccgcagagccggaattagctaaagcgcttacagaaaaaggtgtgacagctatcgcgtacgaaacggtaacggacggacgttcccttccgctgcttacgccgatgtccgaagtggccggcagaatggccgcgcagatcggggcacagtttcttgaaaaaccaaagggcggaaaaggaattttattagccggcgtaccgggtgtatcccgcggaaaagtcacgatcatcggagggggcggcgtcggaacaaatgccgcgaaaatggctgtcggactcggtgccgatgtgacaatgatcgatttgaacgcagaccgcctgcgtcagcttgatgatattttcgggcatcagattaaaacattgatgtcaaaccctgtaaatattgcagattccgtcgcggaagcggatcttctgatctgcgccgtgctcatcccgggagccaaagcgccgactctcgttacggaagaaatggttaaacaaatgaaaccgggttccgtcattgttgatgttgccatcgatcagggcggcattgtggaaaccgttgatcatattacaacccacgataatccgacttacgaaaaacacggcgtcgttcactacgctgtcgccaatatgccgggcgccgtaccgcgtacgtctacgctcgcattaacgaatgtaaccgttccttacgcgcttcaaatcgccaataaaggcgcggcacaagccattgcagacagccctgcgcttaaagcgggcttaaatacggctaacggacatgtcacgtatgaagcggtagccaaagacttaggctatgactacgtgcctgctgaaaaagcaatgcaaggttcggctgcaaaagcttaatagagatgaagaggacagcctgatcagcgggctgtccttttttctttctcacaaaaggaaaaacggccccctgtctcgaatatcaattcatatcccggaagaaaaaggaggattcatatggctgttcagcactatggtgtattaaaaggcactgtgttagatatgaaaagggaaacagatgatgattctccgcattttcaagtcgaggtgctaggcgagcctgatacgcgctatcgctgtgcgatcaatgtcatgtcaagttcaaaagaatcagaggtgctgtatgcggcacgcgatcattttgacgcaagcgcgatcaccctgctgccgaacattccgtacggatataccccaattgatgaaaccagacgtgagctggcgctggattatgtccgcggcggattgtttgatccccggaacatggtgccccttccgcatgaagtcaccggtccggataatgacttaaatgactttattgagacgtacatgcaaaaagccaaatcagaaaaagccaccgtctatatttacggctctaaattcgggccggagccgggcgctgataagattttcgggttcaagccgacaaacggcatgcataatattcatatgaatcagggaaacccaattgatacacgctggaagaaggataacggaacgtggcacgacggcggtattttaatccagtttgcagaccagtgggccgcggtctttttggcttttctgtctcagtcatggtgcacggatgaagaaggccacccttatacattttgtgatcatacacagcttaacggctgatgtccgcataaaaagcctgccgaaataacggcaggcttttcttattacattttagcagcttcggtccgcttcaggctttccggcctcatatcacgccagtttgtttcaatatattcgagacaaacggggcgggtttcattcgtcaggcgggtttcccagccgtccggcacatccagataggccggccacagtgagtactggccttcagcattgacgagcacatggtatgaaccgtcttcccgttcaaatggatttgtcatatcatctctttcctttctttaccggactgtacgccgtccgtttaatttctctgccagaatcgcgccgatgtcggcaagcgggcccggctggcacatatctttatggcggcagtctaagtcataccgctcgattttcccagtaatatacggtttccaagtatccggctcgatcgggtcaaaccactccggaataatcgtggatctgaagaacagcacatctccgtggaacggctttggcttgtatgttcctaacagcccgacagaatttacgtacgtgtctttcagattcatcatcactgactcgtccaggctggctaatgcgcttccctcacggcggagaatggtcagcgcggtgtcaaaatcaagcggctgatccccgaggctgtccgggtcgtaccctcccagggcaagcagcgcaatgacggcttcctcgtcatcaggcgcattttttatcggcagaaaatgattcggatacgcgtcaagcatcaccaaaagcgaaacctcttcgccccggctctgtaattgtgtcgccatggcctgaatgacattccctccgagagaccagccgagcagacggtacggccctttcggctgcacggtgcggattttttcaatataatcagccgccatgtcatctaagctttgcggaagcggttctttttttccgatgcctctcgcctgtaagccgtatatcggataatcagcttctaaagaagacatcagcccggcataacaccagctgagaccgccggccggatggacacagaacaacggtgtttcttctcctgccgttctgagcggaagaagaacatcaagcgcgcttgtgcccgttcctgactcaagtctttcagcaaggcttgccaccgtaggagcttcaaatagtgttccgatactgagctcggctcccatcgcttcccgaatacggctcattaaatgaaccgcaagcaaagaatggccgcctaaatcaaaaaatctgtcatcaataccgacacgcggcagatgaagcacctctgcgaacagctcacacagcatttcttcctgcggcgttctcggtccccggccggtgacctccgtttggaagtcaggcgcagggagcgcttttcggtcaagctttccattcggtgtcagcggcagttcattcatttggacaaaagctgatggaatcatgtaatccggcaggctttcttcggcaaaccggcgcatgtcccccgtgtccaaggtgctgccggcagatcggacaaggtaggcggccagccgtttatctcccggccggtcttcacggacgactgcggcggcatcctcgacatccggatgtttgacgagaaccgcttcgatttcccccaattcaatccggaagccgcggattttaatctggtggtccgccctgcccatataatcaagagaaccgtccgtccgcaggcgggctaaatcccccgtccggtacattctcgttcccggcgggccgtacggatcagccacaaagcgttcggcggtcaggctttgccgccctaagtagcctcgtgccacgccccctccggcaacatacatttcgcccgtgatccccggaggcacaggctccagccggtcatcaagcacatatacgttcagatcaggaatgccgcagccgatgaggctgtttgctctcagttcggcaatgtttttgtctaattcaaggtaactgacgtgcaccgtcgtttccgtaatgccgtacatattcacgagcaccggctgattgtccgcgtggcggctgtaccaatcctcaagccggctcagctcaagcgcctcgccgccgaagatgatatatctgagtgcgagctgatgccccagctctttgtgttctttttccgcatgcatcagctggtaaaacgctgacggcgtttggttaagtacggtcactcgctctttcacgagaagatgcagaaacgcttccggggatctgctgatgtcatgcggcacgacgacgagacgtccgccgtggagcagcggcccccatatttcccagacagagaaatcaaaagcgtaggagtgaaacatcgtccatacatcatcagaattaaagtgataccaatgccgcgtcgactcaaacagccggataacattgctgtgcggaatgatgacacctttcggcacacctgttgatcccgacgtgtaaatgacataggccgggtgaagcggtctcagcggacgaatccggtcggcattctcagggttcgtgacggcatattgccgaagtgtttccttattctgcggatcatccaggatgaaggccggcatgccgttttcgccagagagcttacttgcgccttcacggttggtgagcataaatacaggcttggcatcatgtaacataaaagcgatgcggtccgcgggataatcaggatcaagcggcaaatacgctgcccccgtcttcaggacggctaacagcccgacaatcatatctaaagaacgcggcagcgccagtgcgacaaactgctccgggccgacgccgcgggcaatcatcatgtgcgcgagctgattggctcttttattcagctcttgataagtgagtccgctctcttcaaatactgccgccgtttcatccgattttgcggcggcctgtatttcaaacagttcaggcagtgtctgccgaggctgaatatgctgttttgcccgtttaaccggcaaaagcttccggcgctcttcatcagaaagaatggttaagcttccgatcggtttatccggatgtgatacggcatcttcgagcagaagaagcaggcgtccggcaagtgcttcagccgtttcttttctgaataagtccgtactgaactccagcaggccttcaataccggcaggcgtgccgtcatcatggcgctgttcagccaattccaatgtcaaatcaaatttggacgatccgacactgctgatttgcaggcttgtttccatatcaggaagactgagtacagggtcaggcgtattttggaatgcgagcatcacttggaacagcggatgtcttgaccgggagcgaaccggattcaattcttccacgagacgttcaaacggcacgtcctgatgttcatatgctgcgagattcatttccctgaccctttcaagaagctcacaaaagctcggatcgccagaggtatcggttctcagtacgagtgtattaatgaacatacccacaaggtctcctaatgcgtcatcactgcggccggctatcggactgccgatcggaatatcggttcccgccccgagccgggtcagcagtgcggaaagccctgattgaagcaccataaacaggcttacgcgctgatttctggcaagtgagagaagacgggcatgaagctcttggccgatgttgaccggaatgacgccgcccctgtagcttgattcagcgggacgcggaaaatcagacggcagctccagctgatccggtacattttcaagcgttttcttccagaaatccagctggcgcgcaattaagctctcagaatcagacgcgctgcctaaaagctgctgctgccaaagcgcataatccgcatattgaaccgccagcggcgcccattctgctttttcacctgtttgccgggcgatataggctatggataagtcacgcatgagcggattcaaggaccagccgtcgcctgcgatgtgatgcaggagaaccatcagcgtatattcgccgtcaccaagatcaaacagctcagcccggacggccggctctttagcgagatcaaaccgatatcttgccgcagcggcaagcatgtcttggagctcgtttttgtctgcacgtgtcactgtaaacacagggcgggcttcttcagcaggtaaaataagctgatgagatgatcccttattttccggaaaaacggtgcgcaggctttcatgacggctgacaacatcgtaaaaggcgtgtttcagcgctgattggtcaagcttgcctgacatgcggacaatcaccggaatgttgtaagtcgggctcggcccttcaagacagtagagaaaccaaagacgcagctgcgcaaatgacagcgggatgtgctccggccggtcaaacggcttgagcttaggccgcgcactctttgcggtgtcaagctgtgcggcgagcccggcaacggtcggggtatcaaacagacgtccgatgccaagctctgcgcccatcgtctcccggatccggctcatcaggcgtccggctaagagcgaatgtccgcccaattcaaagaacccgtcatcaattccgacccgcgcgagaccgagaacctcggcaaacagatcgcataatatttcttcctgcggcgtccgcggccctctgtcagacaggacagctgaaaaatcaggtgcaggcagagcgctgcgatcgagcttcttattcggcgtcagcggcaattctttcagctgtacaaacgcgcccggcaccatataatccggcaggctttcgcccatatattcacgaagtccgccgatatcaaggggctgatccgcgacagcataagccgccaggcgcttatctcccggctggtcttcacggacaataacagcggcctgcgaaatacccgggtatttcgacagcactgactcaatttctcctaattctatccggaacccgcggattttaatttggtgatcggctctgctgatataatcaagcgagccgtcctcacgccagcgcacgagatctcccgtccggtacatcctcgcgcccgcgggcccgtacggatcggcaataaatctttcagctgttaaatcaggacggttataataacctctggcaagcccctcgcccgctatataaagctcgcccgcaattcccggcgggactggctgcaatgcggcgtccagcacgtatacccgcgtgttccaaatcggctttccgatcggaggcgcccctgtatggtcttttgcaagcggctgtgcggccgaccagattgttgtttcagtcggcccgtacagattcgtcaccgtacagcctgattcaagcagagcatgcataagcgcgttcggaagcgcctcacctccgacaagcacctgcagcgcccggagggaatcaggttcattggtgactaatgaatgccacaatgtcggcgttgcctgcatgattgaaataccgtatgagtgaatcatgttcgcaagcgcccgcggttcctgaatcgtctctttacgtgcgatgacgcaccccgccccgctgatgagcggaaggaagagctcaagtccggaaatatcaaacgccgcagtcgtaacggcaagcaggcggtcttgtgcgccgagcgggaacatttcccgcatggataagaggaaattgcttacgctttttaatgtcacgactacgcctttcggtttgcccgttgaacccgatgtatatatgacataagcggggtgcaaaggcgaacattccgcctgatcggaacagtcagcattttgagcggcaacggtttttaccgtatccgggtcatcgagaatgatcctttttgcatcactgtcttccggcatgcggccggataattccatcgttgtaatcaggcatgcagggtgtgcatctttgagcatgtatgtgatccgctcagaaggaaaatcaggatcaagcggcaggtatgcggctcccgttttcaaaacggccagcatgctcacggccaactcctgtgaccgcggaagcagcaaagcggcaaattgttccggtccgagccccttttcctttagcatgccggcaagctggttcgcgcgcttgttcaattcggcatagctgagctcttcgttttcggtgatgattgccggccggtccggtgtttttacggcctgttcgtaaaacagctccggcagacttttctgcttctcggccttgcgcgtgtcattccagctttccagtacgcagagacgttcactttcaggcagaaggttgagtgtgccgattttttgtgtctggtctttcacagcggattccagcagaagcaggaatcgtttttgatggttttcaatatcttcggcgctgtacacttccggattcgcatcaaagtccacacgcattccgcttccgtccgctctgtcgtaaacgttaattgacaaatcatcaacgggcccggctgataagttatggacggtgcctggcgctcctgcgaaatcaagagcgtagtcaaacggcatcacattgacttgcgggccgaacagcctgcggttttctccgagcaatttaagatcgcggcgcatgtcttcatggcggtatttctgatggcgccggatgtttcggatttcttttgccacttggctgacggcctcatgaaaattcatatccgggcggagagaaagccgtaaaggcagaagattcatgaccatactcggaatattcagtgaaatcgagccgatccgtcccatcatcggtaaaccgagcacgatatcccctgcgtttgtcatccggtggacatataccgccgctgcagctgtgacggcttcatgccagttcggaattgcttttacatgctgcaaagccgtttcagaaagataagccgtgcttctccgaaagcttgttgacgttctcggcgctctttctgccaaactgacgacatcaggttcatccgcaaatttctccatccaaaattcccgatctttcaggaattgatcagacgcgcggtattcttgatcttcttttaccagttcctccaaagagccgaaggagcgcccgttatccggacgtccttcccgtattgcggtgtatatttgcgccgtacgccgtgccagcagtgaaaaaccgtagccgtctatcgcaatgtggtgaatgcgctgataccagaaaaagcgttccggtcccgcctgaaataaaatgtcgcggaacaaaggcccggccgccatatcaacgggctcagccaaatctgtctgcatgagtctgagtgcggcctgcttcggatcagcttctgaactcacatctatgacatcgatcgcagcttcaaatggaggattgatgatctgcttcggcccgtctgctccctcttcgaagcgggcgtgtaatgacacggcttccgtcagcacacgttcgagagctgttttaaatatgttcacatcgatcgcgccgtttatctcaacatactcgcctgtattgtaaatcgcattatcaggatcaagctgctgcgcaaaccagataccggcctgtgcgcctgtcagaggcagctgttgtgtatcatgcattctattctctccctttataaataatctgcgttcggcaagactttttgagatcgggaagaaagaagtctccaccactcttcaagcgtcgggttctccgccagttcaacaaacgtcacttcagctccgtcacggcgccattgttcgacaaggctcatgattctgacggaatcaaggcctctgtccagcaggtcttcatgatccggaatatcagacggtgattcttgaagaatcgccgcaatttgttcccgcacccggtcttttgtcaatacggcggaagtcttcccttctccttcagaaaccggcgcgccgcccagcagctccagcacttcgtttgtcaaagccgtgtaagcgcagcgctgagacgcatattcgatggccatcttatgtttttctgaagaaaaatcagcaacggcgtctccgataaagaagctttggatatcatccataaatgcttcacaggctgtgacgagacagccgatgtgtgcataaattcccgtaatcatgagctggtctctgccgctttcacgcatgatgtcaaggagattcgtccgtttaaacgcgctgtatctccactttgtgaggacaatgtcctgatcatccggggcaagctccggaatgaccttttcttcataaggcccgcttttcagccccggtccccaaaaatccgtcagcagcgcgcggtccgccgggtcttggctgcccggctgcgcggtgtacaccaccggaatgccgagcgctttgcattgctcttttattttcttgatattctgagccgcctccgtgatcggagccttccctttctcaaaagcatcgacgaaataattctgcatgtcatggatcagaagcaccgcgcgtttcgggttcagcgtccacgatactttattttcaggcatatctgacgctgtcggcagcgcatatgcgggaattgacggtatagccaatgtaaacacttccttttttaagattgtttgatttcagcaggcttcaatttttgggcgatcgtttcgcgaaggtcctttttgctgaccttgccgacgccggttttcgggaaagaagcgataaattcaacccggtcgggaattttatatgccgccagcccgcgctcccgtaaaaacgctttcagctctcccggtttcggcgcttctcctttcggaatgacgaacacacaggaccgctctccgagaaaatcatccggcattgaaaccatggccgcatcatgaacggcaggatgggccagaaggtgattttccacctcttcagcggcaatcttttcgccgccccgattgatttgatctttcgcacgtccttcaacgatgatatagccgtccgccgtcagtttgacgatatcgccggtctgataaaatccgtcggctgtgaatgatctttcattatgttcaggcgctttataatacccgcgaatcgtgtaagggccgcgtgtaaacaaatgtcccgcttctccgggggcgacatcccgcccgtcatcgtctaaaacccttacctcatcaaaaggtgacatcggtctgccttgcgtattgacaatgatctcttcaggatcatccagtctcgtataattcaccaatccttccgccattccgaaaacctgctgaagggtgcatccgaaagcgctctttacgcggcgggccgcctcagcactgaatttggcgcctcccacctgcagcacttgaaggcttgataaatcatcacttcgcgaaccggatgcgtccatccacaccatcgcaagcggcgggacgagcgctgtaatcgtgacacgttctttttcaattaacgggaagcagtcatccggactcggcgtcggtgacagaacaacacggcctccggcatataaagttcccagcacacccggcgagctgagcggataattatgcgctgtcggcagagcggccaaataaacgctgtgatgatccaagccgcatatttccgcgctgaggcgcaaactgtatatgtaatcgtcgtgtgttcgcggaatcagcttggacagccccgtactgcctcctgaaagctgtaaaaaagcgacttccgccgggcttacctcttccagctgaacaggctctctatgcaggctgctcagttcctgaaactcttcagcttcgccggccacaatgacatgcgccaaatccggaagtttgtctttcacctgtctggcaagcgccctgtaatcaaaacctgaatgcgtatcaggaatgatgtatgctttcgcctctgcaaactcgcagaaatacgtaatctcactgcttctatgagaaggcagcgcgaaaacgggcagtgctccgagtcggaacagcgcgaaaatcacttcaaaaaactcagcgatattcggcagctgaacgacaacgcggtcttccttttgaattccgagcttatgcagccccgccgctaaacgatcggccctttcatctaattctttgtaggtccaatgtacatctttacacgtcacggcagtttgatttccgtataaagccgcgcgctctttcagcattcctccgaacgtctcacccttccagcagccgtcttttcggtatttttcagcccattcttccggccatggcgtaaatccagtcagcacgatccgttccctccttttttacaactcatcttggtaaagccccatcgcccggagcatggtgcggaatttcgccgatgtctcgtccagttcatcctgcggctttgatccggcgacaatcccggcacccgcaaagagccggagagaccttgtttccgcttcggcgcagcgaagtgcgataatccattctccgtcaccttcagcatcacaccagcccgccattcccgtgtagaaattgcggtcaaacggctctatatcctgaatcgcttctctcgccgcatccgtcggcgttccgcatacagcgggcgtcggatgaagagcgatggccagctcaagcgatgtcgttgacggatcactaagctctccctttacctcggtggacaggtgccacatcgcctcagttttaatgagtgacggtttttccggcacatcaagcacacggcagaacggttttagggcggcggccacggcggccacgactacggcatgttcatgcagatcttttgctgattgcagcagttcttccgctcttctctgatcctcggcgggatctgtgctgcgaggtctggaacctgccagcggattggacagaatcgatgttccgtttttggacagcagcagttcaggacttgcgccgaaaagcgtttttcttgtttctgacgttcccgtcacatccgaagcgaatgtatagccgcgcgggttgtgctgcgccaaatgcttgacggcctgaggaatgtcgatatccttttcagcggtcagatgaagcgtccttgacagcacgattttgctgagcgggccgtccgtaatgttgaatacgccttgttccacaccgctcataaagccctcaggctccggaacgggacggatgtcatatgtattggattgcggcttttctgcggaagattccgcaaacgaaagcgggcctgccgtatggacattcttcggtacaaaaagccgggaagcttttctgccgtcaaaaggaatggcgccggccgcaatcggatgtttgatgccggcttgctttgcctcaagaagcgtctgtcttacgcgttcaggcagtgaatccagctgattctccgcgtctgcatccggcacttttgcaaacacaccttctgcaaggagcgtccttttcggggaagctaaaaagaacgctccgggcttgtaagcgtccagcacctcttttgcagacacttccgtcaatacatgttgatttgtcatgtttgtccctccttctcgttaaatcaaacgcctaaagtagcgccgccatccacgcataaatcatgcatcgtgatatggcttgcctgttcagaggccagaaacaaaacggcatttgcaatatcagaaggctttgccagcttttgaagcggaattcccgttttatatgtatcaagcgaacctctgataacgtcctgtgctccgttttcatcccgccacagcgcccgctgcatgtcggtttccgttgaacccggagatacgatgttgcagcggatatgatgggccgcaagctccagtccgaggcatttcgtaaacatggcggcagccgcttttgacgccgcataagccgccatggaagcacgcggaacgccggctgcattcgaaccgaccgtaacgatggcgcctttttgacgctcaatcatgtaccggcttacagcccgcgatacatgaaatacgccggtcgtattaacagaaaatgtttgatcccaatcttcatcactaagggattgcaccggacccggccgcagcacgcccgcaacgttcgccaatatttcaataggccccatgtcacgttcaacggcagcgatgatatcattgacagccgcactgtcagatacatctgcggcaaacccctgcgcctgcacgcctttttgccgaagtctgtcagttagcccgggaagcaggtcttcatttgtatctatagctgccacatttacgccttgttcagcaagggcaagcgctgttgcttctccgatgccttgagcggcgccggtgacaacggccgttttccctttcattcccaatgcgtccatattatcattccctttctatattgataatgattatcattatcaattatgattcaagacaatcatatccaaatcaaaacacgcagtcaattagaaaattagaatcagccgcatttagttcgaagggcctgttttttctcatgtgggagaatacggggtatgcggccctcccggattcaggcagaaacgcagggctctgctgattaaaacgggcaggacagaaatatggccctctccttcaaactcgctgtattcagcacggactccatcatcttcaaatccggataataaagagtacagcgcctctgcgtgctgcgggattctgcttttatgtgttttttcaatttctcccgcagccagcaatacactgacttgaagattttccgcagagagccggtctgacaaacgttctgcgttttcctgaataaaacgcttgttccaatgaattgacggacttcccgcaacataggtctggaacatgtccggcctcgtcaaaagcacttgcagcacaaaaagaccgcccagcgaatggccgaaaatcgtctgcctgtctctgtcgatcggataatcccgctccatcgcgggctttacttcttcttctataaactccagaaacgcttccgcccctccctgttcgggccatgccgcgccgcgcggatgcaccggcagttctgattcagaaagcggcatcgtaaaatcactgtgccgttcggcggaaaacggctgatctgtcgggtagccgattccgacaatcaccgccggaacaacgcctgttttttcaggccgccggctttgcacccgcaaagcttcggccattgtaccgaacacggaatttgcatcaagcaggtagatgacggggaagccggaggcaggcggttcttcctgaggaaaagagacaaagatacgatacgtacggcctccttttgagcgcatttctcttacttctgtgcccggaaccgcgtatcggccggccggcgcgaacccccggtttatttgttttccgtccattatgtgttcatcccctttgtggcaattactttatctatcctcattgataatgattttcaatatcaaaagacacctcaaataataggttttttgccaaacaaagtcaatggatttttgatataaaaaaagcaccttattttaataaggtacctaagaactatatagggataggggcttaatcccatgtaaagcgctcattcttccatggatctcccctcatatggtagccgtttttctcccaaaagccggggtggttttcctttgtaaactgaatgccgcgcagccattttgcgcttttccagaaataaagatgggggaaaacgcctctgagcggatagccgtgctctggcgttaacggctcgccgttatgcgcatatgccagcagggatgtttcccgcgtaaaatcagaaagcggcaggttggccgtccagccctcttcagcgtgcagaatgacgaatcccgcttctttgtgcacacccgctttctcagcgatgtctttggcgcgtattccctgccagatattatcaagacgggaccagcccgtgacgcaatgaatatcatttttcacttcggcttccggaaaggctttgatatctttaaagcttaacagcataggacggtcaacaagcccgtacacttgcagattccattttgacatatcttcataataaggaacatttccggcgtgaagcacgggaaacttcgttgtgacattttgatttggcggaatccgttccgactgttttgtttgtttcgttttcccgaaaaacatatggctccctccatttagtaaacctgtattaaatctttgttgacaatcaatcacccttcgattacgctaatctggtacaagtgtaagggggaaaaacaaatgacacaacgcaaccttcgcgcgggcgatatggcgctgatcggcatgtttgccgccctgatggccgtcggcgccaacattacatcaatggctccttttttgcaagttgcgggaattccgttatcgctgcagcctttcttttgtctgttagccgcgatgcttctcggcgccagacgggcagccattgcaatgacggtatacgcattggccggactcgcgggggcgcctgttttcgctcaattctcagcaggctttgcgccgtttatcggaaagagcggcgggtttattctcgcttacatcccggcggcatttgcagccggatggctgctggaaaaaacaaaaaaacccggccgcctgcattatgcatgggcctctttgatcggtaccgccgtcatttatatcattggcacgacctatacgtatattgcgctgaaattatggcttcatgctccgatcagctacggaatggcctggttttacatgatatggtttttcataaaagatatcgttttagcactgttattggcatcaatcgcgcctgccgtatacaggtctattcataaagcgacggggttcagcagaaatccggcgtaagatgttctcagcatacaaaaaggctcccctttccgggagcctttttttacaggacaagcgcggcaatccagccgaatatcacaagcggaatgttatagaaaataaatgtcggtacgcacgtatcccaaatgtggtggtgctgtccgtcggcgctgaggcctgacgtcggcccgagcgtactgtcacttgcaggagaacccgcatcaccgaccgcggcggccgctccgattacggcgatcgtcgccatcgggctgaatccgagctgagcgcacagcgggacaaatatggtcgtaatgacgggtacggttgcaaatgatgatccgattcccatcgtgattaataaaccgaccaccagcatcaggagcgcgcctaatgattgactgtgaccgataaagcctgttgatgctttgaccaaggaagccacatcgcccgttttgttcaatacatttgaaaaaccggccgcaacaagcatgacaaacccgataaaagccatcagaatcatgccgtccgtgatcagcttatccgcttcattgcgcttcatgactccgctgataaacagcgtaaacaagccggcaagcgcgcccatgatcataccttccactccgagcacttgtgacagatagagctgaacggcaagcgacacggcaatggagatcagggcgatggcaatgctttttttcgtataaggagaagacgacagtccggcaatctccttcgtctcatatttcttcggtttccggaagacgatgacggataaaattaaaccgactaccatcccggccgtcgggatgattaaagcatacggaatatcactgagcggcacctttaaaccggctgacgccatattatctctcagcatcccctggaaaatctgtccgaatccgacaggcagaacgatatacggcgcagtcagtccgaatgtcatcacacacgcgatcagcctgcggtctatttcaagttcgttaaatatttttaaaagcggcggaatcaatacaggaataaacgcaatgtgaacgggcaccacgttttgcgagaaacaggatatgattaaaataaccagtacgattaacacttttgacagtgcttttttccgcgaatcttccttttttccgattagtttgacagacgcttccaccattgcatcgggaagccccgtcttcgtcagcgccgcggcaaatgctccgagcagcgcgtagctgaccgcgacggtggcatttccgccgagaccgtccgtaaaagccttcaccgtctctccgaggcctaagccgccggtcagcccgccggcaagcgcgccgatcattaaagctataataatattgacacgcagcaggcttaagacgagcataagcaatactgcgacaacaacagcattcattgatgagtccctccaaaaatcctttagtttgctaatgtagtagataattaaagttaacatacattctgcgctttagtcaactaaagattttggaaatcaaaaaacccgctgcatcaaggcagcgggatgctgttatctttcgggcgtaaaccgctcagtcaaaacagccaacgtccttgccatgacgcctgttgcgccggcagggccgaagcatgtcgctttattcgccgtcgcggttcccgcaatatcgagatgaacccacggcgtgttttccgcgaattcaccaaggaatgcccccgccataatcgcgtggccttctcttcccggagaattgttcaaatcagccatctgactgtttctcacccgttttttatccttttctgtaatcggaagctgccagatcggctcgccggattctttcgccgattccgccacctgttcataaaacgcggcgtgattggtcatggcgcccgtcatttcgttacctaaggcgacaatgacaccgcccgttaacgttgcgacgtctacaaggacagaggctccgtgctgcttggcgtatgtgatgccgtcggcaagcacgagacgcccttccgcatcggtgttcaggatctcaatggtttttccgctgagcgaaacgatgacgtcatccggcttcatagcatcggacgaaatcatgttgtccgtagacggtatgacggcgagcacgttttgttcaggccggagttcgccgataatttccattgcgcccaataccgaggcggcccctcccatatcgcttttcatgccgacgatgccggttttcggcttaattgaatatccgcccgtatcaaaggtaattcctttaccgaccaggccgatgacgtcttcccactgatctttgccctgatacttcagaacgatcattttcggcggttcggatgagcctttgttaacggcaagcagcccgcccatgccgagctcttccatttcatctttttctaaaatttcacactcgaaatcgtattttgccgcaagctcagcggcatatgacgccaaatcagtggccgtcagcatattacccggcatattcacaagcgtgcgggctgaattcgtcccttggccgtatgccgcgccgacgttcaggccggcctgcacttccctcaggtcttcttcggtcacggcgcagactgatttcagttcctgatccggctcattcgatttatgtttataatcctgcacctcataaaccgcaagcagacagctttccgaaagcgcatgagcggcatcggcggcaggcacttccccggagacgaatgtatcgagcaacacggatacttcctgttttttatcttgatgaatctgctgaaatactcgtgcaaagcattctttcgtatcttcaaacgaataatccgcttctcttcccaggccgataaaataaatacgtttcataccggtcgcagccggagggtatacttttgatacacgattgcgtttggcggacacatcaccatcctttaacagctgggtcagatgaccgtctaatttatcatccaattccttcgtaaatccgttcagcgtgcttttttgaaaaagaccgatgaccagtgtttcgggatgccgcagttgatcagatgcataaaacatgagtacacactccttatgtgggtatttgttatgtaaagtggtataatgaaaaaacatttttcattgattttattttaccaaactaagggcgttttctgcagtttttcgatacgatcggaatcagcagatacagaaaggatgtcgcatatggatgtacttatgaattttcctttactggcgagttttgccgccattatttttgcccaagttgtaaaagtgcctattcaatttatcgtatccaaaaaacttgactggtctcttgtgacgagcaccggcggcatgccgagctcccattccgccgccgtcaccgcgctgtcaaccggaatcgctttggaacagggactggactcgcccctgtttgcagtcgccgcgattttcgccgtcattacgatgttcgatgctacaggtgtcaggcggcatgcgggtgaacaggcgacagtcattaataaactggtcatcgactttaatcggtttgtcagcgaagcgaaggactttcagaaagcggaagagaaagaaaaacagaagaaactgaaagaactgctcggccatcagccgattgaagtgttcttcggcggcgtcaccggtattgtgctgacattgattttagattatttctttatgtaaaaacgcttcagcggatgctgaagcgtttttattcttttaccgttttgtattgatttctgaacacttgcagcgactttgtttcgttcagctttacaagttcgtcctcggtcactgtgccgttcccttttttaataatgtagacctcaagtgtttttttgccccaattgttatagacgtccttgacggtgtcaaagtagaggtcaaggcggctgcctttaatttttgagccggtatcggcgacaaccccgtaaccgtaattcggtataaacagaatcgtcccgatcgggaaaacagacggatcggccgcaacagttgaatataaatcgcgtttgaccttcacacctgaatatgtaattccgtactgcggatgacccggagattttccggtagattccgctccggcggtataaccggtggccgtcactttttgtgacggatagcgttcccagtcaaaagcttcttccagcggctttaccctgcctgatgccttcttttccggctgattctgtaaggattgaaacggagtgccgatgtttttcaaaacggcgccgcgatgttccgtcatccaatttgtcagatcctttgcttcaacaccggttatagaaaagtatgtcgcatggcatgcgcccaaaaagagcacgatcatgaatacgcgtctgattatcgtcaatctgaaatcactctcctccgagtcattgttcccaactcggtgaggtgctatacaaaaagcgccgtgacacaaaaaaagctttcttgaataagaaagcggtttaaaacatttgatatcctctttttctgagcgcctttatggcaatgcctgacatgatggctcccgccagtccgcccgccaaaatcacgacatccgcaaccgctaatgacatgatgcgctgaaacaggctttgaaaggattcccccggcgcctgcacgtaactgatcatctttttattgctgataatgaaaaggcatacaatcggatagacaacagccataatccacgacattctaagcagcatgttcaacagaaagcctatgccgaaaaacagtacaaaaaatagtacgattgagatcaggacaaccggcaaactaatcacaaacatccaccccctacagcactttcagtgtacctcgggggcggtaaaaaagtcaacgtctggaaaaatcagcgtctctctttgccgcttccctggcaggagggacatgtttcggagccgccaagaagcaattgaaaataccctttacctgagcagaacggacacgccgccgtgctttttgctgtcgttttcatgcggatcaccctttttcttaattttctgataatatatcatatttacttgtcaagcaccaagtcagaatatgtaacataacaactcatgtaagcggaaacattcttttttttcttttacatgctttttatagcgctcttttttaaaagaagagaaaacccgcggctgcgggttttcagaagaatttaaacttcccttttttcagcgtcaggcccagcccgccgatcataaagagcgagcggttatcaatgacctttttcataaaggacgccggcgtgcctttaagcttcctgccgtatacgactccgacggcgttatgctcaccgagggaggcgaccgttcctttaatgtcaggcttgaactcttcaagctggcctccttttatcaaaccgcccagatttttggcgaccgtttctccttgctgcatcgcgatctgagcagtcggcgggtacggccgttccgtctcttcattgataaagagcgagctgtcgccgagaataaaaacgtcatcatgtcccggcgcccgaagatcagggttgactttgacacggccgcgcatattttcaaaacccgcttcctccacgatcggatgtccgcgcacacccgcggcccagacaacggtctgcgatttgatttcttccggctcttcatctttcttgccgactgtgacaccgtctgcgcggcattcttgaaccgcggtgccgattttaaattcaacgcctttgctctcaaggtattgaacggcgtaatcgacaagctccggatcaaatcccggcaaaaccgtcggggcggcctcgacacagacgatccggacgagactttcatctatatcataatatctgcataactccggcttgcggttcgcaagttcaccgagaaattcaattcccgtaaagcccgctccgccgacaacgatggttaagcggtcagggcgtttttcggcctccgtattgtatgtcgcaaattggagctcaatatggtctttcagctggcgcgacgtattaatattcgcgatcggaaaagcgaattcttttaaacctttaatcccgaatgtttcagggacggcgccaagcccgatgacgagataatcataagggatgtccccttgtgaaagcgtcacctttttattttgcacatctatcgcttttacggtatcctgcacaaatttgacccgtgattcattgattacatcttttatttgatatctgcagcggtcatgatgcagcgttcctgcgctcgcttcatgcatccatgtcgtttcataatgataattgtgtttattgaccaaagtaatgtcggcgtcatttgccccgatatgcttcggaagccttgttactgtcattaatccaccataacctgcacctaaaaccacgattttgggtttattcaatgccatcacatccaccttcttttttttgctgttagacgcataatcaaatcaacatttgtattagcttcagcttattggcgggattttatgaaatgaaatataaaattttttagaaaaccgcacatgtctgcatatcaccatactatccggaagaatcggaaaacattcaggaaaaaacagattggaatttgtccccatcttagcggcggccgcaatttttttcaagaatgaagcggccgggcggttttcggcactcgtcatcctttcaaattgtatgttataattaataacaattttcaattaggaggcaatttggtatgcaagaggattcaaaggtttatgatattacggtcatcggcggcggtccggtcggcctgtttaccgctttttacgggggaatgagacaggcgagcgtcaaaatcatcgagagcctgcctcagcttggcggccagctcagcgcgctgtaccctgaaaaatatatttatgatgtagccggattcccgaaaatccgcgcccaggaacttgtgaacaacttaaaagagcaaatggcaaagttcgatcagaccatctgcttagagcaggccgttgaatctgttgaaaaacaggcggacggtgtgtttaagcttgtcacgaattcagaaacgcattattcaaaaacggtcattatcaccgcgggaaacggcgcatttaagccgagaaagcttgagctggaatcagcggaacaatatgaaggcaaaaacctgcactacttcattgacgacctcaatcaattcgcaggcagacgcgttgccgttctgggcggcggcgattccgctgttgactgggcgctcatgcttgagccgattgccaaagaagtcagcatcatccaccgccgtgataaattccgcgcgcatgagcacagtgtcgaaaacctgcataattctaaagtcaacgtgctgacaccgtttgttcccgctgaacttgtcggtgaagaccggatcgaacagctcgttctcgaagaagtgaaaggcgaccgtaaagaaatcattgaaattgatgacctgatcgtaaactacggctttgtttcttctctcggcccgattaaaaactggggtcttgatatcgagaaaaattccatcgtcgtcaaaagcacgatggaaacgaatattgaaggcttctttgccgccggagatatctgcacatatgaaggcaaagtcaagctgatcgccagcggtttcggcgaagctccgacagccgtgaacaacgcgaaggcttacatggacccgaaagcgcgcgtccagccactgcattctacaagcatgtttgaaaaataatataaaaaagagtctgtgtcataccggcacagactcttttttatttaaacatccaaatataattcatgacggttccgacaacgagcgcaatgacaagcgccgacacgacccaaatcgtgcctaaaataatccggtcctgaattttctgggctttcgggctgtgcccgggctgtttttgttccataccggcccctcccttcttctgcaaatctatctatcgtaacaaatgtcttacaacaaccaatactactatgataaccaaactgcaaatggatgacaagctgaccgcatatgaggcagcatgaaatcatttgacattcctgacaaaacaaagtacattataaaaagacgaacattttaattttatttaaatatattattcgcttttaggggtgttatatatggaaaatgtatttgattacgaagatattcagctgattcctgcaaaatgcattgttgaaagccgatctgaatgtgatacatcagttacgttgggcggacacacgtttaaacttccggtcgtaccggccaacatgcagacgattatagatgaaaacatcgcggcctggctcgcggaaaacgggtatttttatatcatgcaccgcttcgagccggaaaaacgtctggcttttgtccgggatatgaaagcgcgcggactgatttcttccatcagtgtcggcgtgaaggaaaatgactatgaattcatccgggagctgaaagaacaggagctggtgccggattatattaccattgatatcgcgcacggccattccaatgccgtgatcagcatgattgaatttattaaagaacatgtcccggaaagctttgtcattgcagggaatgtcgggacgcctgaagccgtaagggagctggaacgcgcgggcgctgacgcgacaaaagtgggaatcggccccgggaaagtctgcatcacaaaaattaaaaccggcttcggaaccggcgggtggcaattagccgcgcttcgctggtgcgcaaaagcggcgagcaaaccgatcattgctgacggcggcatccgcacgcacggcgatatcgcgaaatccatccgattcggcgcgtctatggtcatgatcggatcattattcgccggccacgaagaatcaccgggacaaacgatcgaaatcgacggaaagctgtacaaagaatatttcggctccgcttctgaatttcaaaaaggcgaaaagaaaaacgtcgagggcaaaaaaatgcatgtcgaacataaagggtctttgcaggacacgctggttgaaatggagcaggatctgcaatcttccatctcttacgccggcggcaatacactcgaagccatccgtaatgtcgactatgtaatcgtaaaaaactctattttcaacggcgacagattttaacatgcagcagagccgctcgaagataaaaaaaatgacattcatattgaatgtcatttttttattaaataccgaaataaagagccgcactggctaacagattaatcacaaaaataaacaaaaagatgtaacgaatgaatttattttgcaccggagcaaatataaagagatatagtcctgccaccccaaaagtaagaacaggaaacagccactcaaaggataaagaaatgatataaccgataatcataacaatcggcacaccgattaatgataatttacttctcatatgatttctgccccttttacttaaaaattggtgtgatgtaagcttcaataacggcagcggcgatcagcagacaaataataagcagcaccaatattccaatatgcctgaacattgaaaccattatctttttttccttagaaaaacacagcctgatgaccaattcaacgcccttaaaaccaatggcgccacttaataataacgcaggaacttcaaatataccatgaggaattagcagtaaaaaaatctgataaaaaggaaccccgctatgcagattttctataatagagccgcttaaaataaacccgttggtgaataaataaaagattgaggtcaacccaaaggtaaaaaaacccgcggctaaaaacagacaagcgattgcattgtttttcagcagttcaaccgcgcctgacgagccgttgtaagacgctgatgaaacaaagtgatcggaaaaaaacgcagcgatcacaccgcctgaaaaaaacagcactgacgcggttaacggaatggcggacgttctgattgccggcaacatgcggttcatcatgtatagatacgctcagccaattcttcaatctcttctaatgaatgctcggatgactgatactccgccgcaaaaacgccttcatgtataataccgatcgtatcgcacagcgaatgcgccagctccagcaggtgagtcgataacaggactgtatttccctgcttgacgtactcctttaataacgtccgtatcgttttaccgctgattaaatcaatgcccgtcagcggctcgtcaagaattaatatctttggctgatgaatgagcgctgccgcaattgataatttttgtttcattccatgtgaataagttttaatcagctgatttccgtcttgagaaagcttcagcgtctccaacatattctttatataatcatttgtccgctgagacggaacttgaaacatttccgctgtaaaacgcaagtattcgactcccgttaagtaatcatataaaaaagcatggtcgggcacaaaaccgatatcagccgatatttgccccccctcttctgaatccagttccttgccgtcaatcatgacgcggcctgaagtcggtttaagcaggcccgaaatgattttcaaagtcgttgttttcccgactccattagtccccagcaaagcatagattgagccttttttcacctcaaacgaaatatctttcaatacctgtttttcactatagtttttttgtatattcactaatttaatcattgttcgcaaacctttccgccatattgattctgcgaagaaacagaaacatgactccatagtttaatagtgtgaacaggacaaaaatacctgatgcagaatgaataagcatcgtttcaagttccggctttttatagataaaataggacgtgatcgcagcgatttgaagcgacacaatgaaaatgaaagaactgtataagttgttatacgtctttgctttccccgcttctccaatttcgtacagatgctcccagtttttcttaggatacagggcggtgcttgaaatctggacgagactgtataaaaaacccgaacataaaaacacaataaacaggtaaatcgtcagcgccgcggaagacggaaaaaacaccgtaatcaaaatggtgatgatgaacgaatagataagagcggcgagattataaatacatactttcggaaacaccagctgccacgcatgtttgatattccggtgaaacagatgctgattttttatttccccgtcaactgataatactgttttgagcgcatctccgacgagctgatacgaaaagttcgcaatgataaccgccgcagacacgatggcggctgccgaatacccgataaagtgatgcgatagaagcggaatacaaaaacctaaaaacagcatgaacaaatacagcatactgccgaagttcctgataaaaaacccgtcaattctcgataaaaacagcagatccttttgaaaaacggcatgaaatattttgttatttctatataatttcagctttggcgcaaaatcagcgtttgtcaaaaacatataaggaataaggtccattttcttcagcgtggccgaccacagtttaaacatccccgccgttaaaaggacggcggccgcaaacaccgcagcgaaaacgagcacggaatgtgagcggaatgctaaccatacatacggcgtattcatgaggatgttccggaaagccggtgactccgtaaagcttgaaatatcctttgcggtatactccccaaacacgagaagataaacggcatacccgactgcaagcggaaccagcaggctgacgctgaataaaatgcctttcaggattttcaagtaaaacaatttgctccatatatttgtaagaagataaacaacataagaaaacagcatagataaaaataaattgagaagaaaataaacgaagcccaagaaaaatacgatgatcgccgcagacccggtcatgcctgcgcttgataaaaacaaaaagaccggaaaaacaaaaagataccatacgaaaatggtttttttgatcgcctggccggcaaaaacagaaaacagctgtaaaaaacgcaccttttttaattgatgaatgaccttgcgcgtatccagcagaaaggcattgtgatgttctttaaagaagccggcagcccaaaaaagctgctcaagtgaaacggcgattaaaacaaattgcccccatgcgctgaggggcagctgaatcagttttgtcccgaatacaacaccgcatcccaggaaaacgagatataaacataacagagaaataataatggcagacagcagtttgctgttgagttgaggaatgccccaatcttcctttctttttcgaaacgatgacagggtattatatttgataagagccgcaatttgtttgactatcatactttcaatccttacatatgtatttgggagagaggctctttttgcagcttgtacaaaaagagcaattatttattggtcgattttaccaagcagctgcgtattttttgccgtatttcttaatcattgtttttgctgttgcaacgattgcataagaaatcgcgcctgcgcctgtaacgataccgatgagagaaatgatagaagcaattgttgatgccgcatcaataatatcaattgcttttttagctgctgctgtagagatgcccagagtcgaagctaattcagcattggctgagaatgcatgagccgccgccacgtttaattcagttcccgttaataatagtgcataaaccaatgttgctgcagcaagagccacgccaaacaaaatgaaagactttttattagattttactaagttcatcataacatctccctactctgtttttttaatttataataaaattcagcttaattgactctctcccgagctaaattttatccgccataaaataattaaagaaaatagtaaagagttttaataaaacaaaacatccagtcaaaatgattctcttgcctttactgagatcggtcagttttcctgcggcagcataaagagccgcaattgatatgagcagaaatggatccagcagctgcagactcaagctggtgccgccggcagaatatataagcgaggaatcagccgttaagtagttaacaactgaaagaatcaacattttaaatgccgagattaaagaagtcagtgtatatagaagcaaatatatttttttcggtttttttgtaccgagaataaaagcggcaacgaataatagaaatccgcctatcagaatttccacaaaagttgtgaagatcataaacccttgcagaaacatgacaatcgtacgaacacttttctccccgatatcgtaggtactttctccgacggaagaataatacgactgcagaactttatcggaaatactgaattggaagagtaatgaacagatcaaaatgatgaaaaaagaacttaaaaatatttttttattgctcaattgacctatcatattatcatccttttcttacaaaataaattaactattctatacttttacaatttagtttattcctatcaaaaaatcaatatcctttcgaaaaatatgactttagaacgtgttgactaagagcacatcttccagattttttgattctatataccctttatttttttccgaatttgcaaatagtatgatttgaaccgttgatttgaggatttttgtgaaggccgtcactcctaaacctattgaaaatctgcccatttccttttgtgacatatgtctgaattcatcacattttttttattgacttaaaacatggtttaagtcgtatcatcacccagtgacaaggaaaaaatactgttggaggtctttcgaagacatgttgttcaattcgtgaagcagcagcaaagtgtaatatgacagaatcaacgttacgttattatgaaaaaaagggactgctgccgctgattgaacgtgatgaagccagccggcggttattttcagcagatcaaatgccgctccttgatatcgtgatttgtttaaaaaatacccgcatgaccatcaaaggctttaagcaatatattgattgggtaattgaaggagagagtcctattaaactccggcttgacatgatgaggagacacaagcggtcagtactggatgaaatgtcgtcaatgacaaaggcttatatcaaaagctctgttcaagagacgtaagtttgttgaagtaaaaacaatcggaaaagaggagttaatatgaaactgacgggaaatacaatactgattacaggcggaaatgccggaataggattggctttcgcagaacggtttttaaaagcgggaaataaagtcatcgtgaccggacggcgtaagcacgctcttcaaaaagcaaaggaaacattcccggatcttattacctatgtcagtgatttgagcattccatctgaacgtgtatcactgtttgattgggtgaaagaaaattatccggaagtgaatgtgttagtaaacaacgcggggattcaacatcgttttcatgtgctgaaagcggatgcgaaggacaattgggactattttaataaagaaatcacaacgaacattgaagctcccttccacctgtctatgctgttcgctccgttttttgccggaaaagaagatgcggctgtcattaacgtctcttcgggattggcttttacaccgcttgctattgcaccgatctattcagcaacgaaagcggcgcttcattcatttacaatgagtctgagacatcagctttctgattcatctgtagaagtgattgaagttgcgcctccggcggtaaatacagatttaggcggagcagggctgcatactcaaggagaaccgctggatgaattcgctgatgggatttttaaaggactgaaagagggcaaactagaaatcggttacggttcttcagcggaacggctgcgcatgtcacgggataaagccgatgaacatacggcaaatatgtacaatgcgatgaaacatacaattgaataacctctttgaaaaagcaaaacccgcttctgttgagcgggttttgcttttattaaacagataaacgccttttttaacaatggtgcaagcgccatcgaaaagaaaggcgtcctattttttcatcctgagaatggcgggctgacccttagcactcttccggcgtaccggcgtttttggccgtgcggaaagaagatccgcagccgcaggaagcgatggcattcgggttgtcaatggtgaaaccgccgcccatcatggactgtttgaagtcaatgatcgtgccggtcataatatcaaggctttcgctgtcaaccaaaacggtgatcccgtgctgttcaaacatgctgtctttttcgcctttttcgtgctcaaatcccattccgtaagacaggccgctgcagccgccgccttttacgcccacacggagaaacgcgttttcttcttcatgctctttcatcatatcttttatatgcaaagccgctgcttcagtaatagttactggaacactcataagtagacctccttttttaaaaacggatgctgatatctattataaaccttgaggagcgtatttctcaaacgagctgtttacaaataatagacgccgctgcatacggtttcggcgggtcccgtcatcagcacgtgcccgttgtcctgccaattaatcacaagatcgccccccgctaaatgaacggtgatatcccggtttcgttcggaaacaccgttcaatacggatgcaacagccgccgcacaggcgcccgttccgcaagcctgtgtaatgccggagccgcgttcccatacgcggaaatgaagttcatcggcgctgacggtttccacaaattcgacattgacgccttccggaaatctcgggtctttttcaatgacgggaccgagcgttgtaagaggcgcttgattaatatccgcaaccggaaaaacaatatgggggtttcccattgatacggctgttccggaaagctccgtttctccaaaaacaaaggtttcatcgatcgtccgttcatcttcattgccgagcatcggcagctcttttttggtgaggcgcggttcgcccatatcgacggcgacttcacgcacaatcccgttttcttccgtaatatctgctttcacaaggcctgaaagcgtctcaatgaaaaaggacgtttcttctgtcagcttatgttcgtatgcatactttgccacacagcgaaggccgttgccgcaatttttcccttctgagccgtcattattaaaaatccgcattttgaccggcgctttttctgacggacagatgaggatcattccgtcagagccgatgcccgtgtgaatgctggacactttaacggcaatctcagccagccgttcttccggcagctgttcttcaaattgatttacatatatataactgtttccaagaccgtgcatcttggtaaaacggaatgaattcatatcggcctccaactttttttcttttacttagtataaaagctcttcccctcggacacaatacaaatatcccccgtttttcatacataaaagctccctgcatatgcagggagcttttatcgtttactaaataaacatgccggcaatcgccgcgctgagaaggtttgcgagtgttcccgcaataaccgctcttaatccgaggcgcgcaatgtccgaacggcggcttggggccaaaccgcccagtgtgccgagcataatcgcaatcgaagagaagttggcaaatccgcacagcgcaaagctgataatcgtagacgtttttttagaaaagtccgcaatatgcggaccgaagtttgaataagcgacaaactcattcagcacaagtttctgtccgatatagcttcccgctccgagcgcctcatgccaaggaacgccgattacaaatgcgatcggtgaaaacacgtaaccgagaatggattctaatgtaatatgtttgaaaccgaaccagccgccgattccgccgagaattccgttcactacggcgatgagcgcgacaaacgcaagaagcatggcgccgacattcagagcaatctgaaggcccgtggatgcgccttttgccgctgcatcaatcacattagcggcgccttcgccttcttcgtccatattaaaatcgccttttatcgtctgcgttttttctgtttcaggtattaacatttttccgaacacgagaccggcgggagccgccataaagctggccgccagcaggtattcaatcggaatgcctaacagggcgtaaccgaaaagcgtcgaacccgctacagccgaaaggccgctcgtcataatcgtaaacagctcggaacgggtcaatcccgcaatcagcggtttaatggcaagcggtgattcagactgtccgacaaaaatattcgcagccgccgcaagcgattccgttctgcttgtcccaagaagttttgacagtccgcctccgatgacgcgaaagatgagctgcatgattttcaagtgatacaaaacggcaatcagcgctgagaaaaagataatgaccggcagaacgctcagcgcgaaagccgggctgctgcccacttttaacagcgggccaaaaataaagctgatgccttcgttcgcataatcaatgagaagctgcacacggcttgagaaccataaaaatacggcccggccggcgtcccactttaatacgatgaatccgaaggccatttgtaaacataaacccacaatgacggttcgcaggttaattttgcttttcttctctgataacaaaaaagcaatggctaatatagcaactgccccgagcagcccccaaacgatattcaatgaatccacctctaaaattttatttaaaaaaagtctttattaagataacaatatttatttttgctgtctacaaattttttattttgccaaaacccgggcgcaataaaaaagagaccccgttcggagcctctgattaaaacatcggattttcttctatgaatgtatatatgttgtcaaccaactcagcaggcgtgccccccgtgaccacttcgccgttaaccagggcgaacagggactccatgcattttccgcagtagcttaaacagccgtactcaagcacgtccaagttcggatccttctctaagatctcaagtgcttcctgggaaccgcgcgctaaattgctgacacagaattcaatcatcggattcatgcggtttcacctcacatatgtaccttatcctaacggaatttcctctattcgtcaaagatccggtttcacgctcaatgttatcgtaacatattaattcaggttaaaggttttactattgcgtgttttctggtcaatttgtaggttattttaaaactattattgtggttttagatcaaattcgatataattctagatgttattttacatagttcgttattttgtaacaatattgactaccatatttttcgggcaaaaggggaatcattatgaaaaaattggtcttgatcggcgggggttacggaaacatgcgggtgctgcaccgcttactgccgaaccagcttccgtcagatgtatccatcacgctgattgacagaaacccgtatcactgcttaaaaacagaatattatgcgctcgcagccggcacgatttctgatcatcatatcagggtgtcttttcctgagcatccgaatctggatgttcaatacggtgaggtggcttccatcgacacgaaaaacaaacaggttctgtttcatgaccgcgaaccgatttcttacgatgacgcggtgatcggactgggctgtgaggataagtatcataacgtgcccggcgcgccggaacatacttacagcattcagaccattgatcagtcacgcgaagcctatcaaaagctgaacaacctcggcgccaatgcatctgtcgctatcgtcggagcgggattaagcggcgtggagcttgccagtgaattaagagagagccgtgacgatctgaagattatgttatttgaccggggcgacctgattttatcaagctttccgaaaagactcagcaagtacgttcagaaatggtttgaagaacacggcgtcaccattatcaataatgcgaatattacaaaagtggaagacggcatcgtttataatcatgatgaaggaataccggccgatgccatcgtgtggacggcgggaattcagccgaataaagccgtcagagaactggacgctgaaaaagacccgcaaggccgcatcgttttaacaccgcatcacaatcttccgggcgatgagcatgtttacgtcgtcggtgattgcgcgagcctgccgcatgcgccgagcgcccagctggctgaagcgcaggcggaacaaattgtgcagatcctcctgaaacgctggaacaatgaagagctgccggaaacaatgccgcaatttaagctgaaaggcgtcctcggttcactcggaaaaaaagcgggcttcggtcttgtcaacgaccgtccgctcatcgggcgtgtgccccgtttattaaaatcaggccttttatggatgtacaagcatcataacggctgataagaaaaaagccgctgattgcgatcagcggccatttttaagagcccgccacatagccgcgcttttccatttcttcatatatatcttttaaatgcggattcccttcccccacaatgacatcctccaccagcacgagcggatagaaaaattcatcgttcttgatgcgctccgcaagctcttctgtctccttttgctgaggcggtgcctcaatatcaatataccgcatgttaaaaggctgctccgggtatttccgtttcagcgccgcctccagccattcaaacgtatctttggcgctcggcatattcacgcagcttgcgcaaagcgtttcagcgccgtaaacactgagcgtaaccggctttgtcatgtatatcatcccctttacaccagtatacaaaggacggggcagcttttgtataaaaaacggtttttatgttcaagtttaaatatgctataatggagaaagcagctttgcaaaccaaacattagatttttaccgttactgtgaatataatggttttatgtatatgaaaggagcgaatctcatgactgaggttgaaatgaaagagcaagtacaggaagtattggataaattacgtccgtttctgcttcgtgacggcggtgactgtgagcttgttgatgtagacgaaggcattgtaaagcttcgcctccttggcgcatgcggcagctgcccaagttcaacgattacgctgaaagccggaattgaacgcgcccttcttgaagaagtaccgggtgtcgttgaagtagaacaagtattttaatcataaaaccaggctgcatgacagcctggtttttttatttttacaaatagtcatcaaaccatgaacaaatataacggatgcgtttcatccgctgttcgggatggccgcttctcgacagctcatgcgtagctttcggaaatcggatgaacgacgtcgttttgttcagtttcttcaacgcggtaaagagctgctccgcctgctctatcggacagcggtcatctcgctcaccgtgcaggatcaaaagcggcgtcgaaacgcgggatgcatattttacaggagaacgatcccaaagcttatccgcttcctcaaacaaatcatgtccgagctgccagtcggtaaaaaagaagccgatatcgctgacaccgtggaagctgaaccaatttgaaatggagcgctgcgtgacggctgctttaaaacggcctgtctgtccgacaatccaattcgtcataaaccctccgtagcttccgcccgtcacaccgagacggccgctgtctaaaaacggatacgcctgaacggcttcatccaccgcctgcatgacatcacggtaatctccgcctccgtaatcacccctgacacgattgacaaaatcctgtccgtagccgtggcttcctctcgggttgacatacacgacagcatatccttgtgcggccagcacttggaattcgtgaaaatacgtatggccgtacatcatgtgaggcccgccgtgtatgtatagaatgaggggatatgtttgatcctcttcaaaaacggaaggctttaaaaaccagccgtttaccgtcagcccgtcctttgtttcatattgcagcttttccggcacggatatgatacgctcctctataaaccgatcattgtaaaatgtcaattgcctctcttccccattttcaagtgaaatgctgtaaagctcggaaggctgtgcgggtttggcaatgacagcgatacagcttttctgatcaggatgaaaagcaaaaccgttcacgtactcttcttctaatcggatcggatatacgaggccgtcaatcgagatataataaataccggtgcttccctgctcgctcccgagaacgtaaaagccctgcccgtcgtttgtccataccggccggggcgtcactcctcctatgattgaatccgcaatcagcgcatcgctcaaatgaacatccagcatgtcggtcaggcaggacagccgctcagttttcacgtcgtacagccacgctttctctaaagtcgcattgcgaaattcattctcatggcccagcatcgcgatataagaaccgtccggtgaaaacacgcaggaaccgaaagaaccgcggtgcggcgtaatctgcttcaggcttccgtccgccagattcatcagatagacatcgctcggctttccggcgtcacccggctcgcataaattggcggtaaacgcaagctgcctgccatccggtgaaaaggccgcgccataatgatcagcttcatgatctgtcagctgctgaatctcccccgtttcaagatgaatcagcacaagctgtgtccggcttccgttcagcaggcccttcccgtcacgtttatatgttaatgattgaatctcaaccggctcatactcgtcatgcttctttttttctttctcatcggcgcgctccgctgatgtcagactgacggacacaagcacggatctgccgtcgggcgcccatatcggatctgatacgccccaaggaatatcggcagcctgttccgcctctccgccggcagcgtcgatgatgtacagctgagggatgccgtcctccctgtcagaaacaaaggcgaggcgccgaccgtcaggcgaccaccgcggacttgtatttttatcgtccccgaaagtccacgggtttgagatgccggattctgtgtcatataccataatggctgaggaataggaatcacgcttatgattgactgttgtccggacgtaagcggctcttctgccgtcaggggcatattgcgggtctgtcacggatacgagtgacgcaatgtcctcctcggttatgagttttttcaatcgtatctcctccttttcttttttatttcgcttccctaaataaaaatccttctccagaaaaagaaagcgtccttctctgatgggaagaacgcttttttatcattatacacttttcacctgctctaaaggattccgttcaattacgcttccttctgacgggacggtaagcgccgcaatctcacagtgagggaaatgctcagaaagctgttttctcagctcttctccctttcctttttcaatcaggacaagaatcgtcggtcccgctccgctcagcgccgttccgtaagcgcctttcatttcggccgcgtgttccacctttgaaagctcaggaacaagcatggcgcggtacggctgatggaggatgtcttttctcatcattttcccggcgagcgcccagtcatttgacatgatcgcagcaacgagaaggttgctgacggcgcttgctttaacggcgcgtcggtacggcagctctttcgggagcacgtctcttgcgtccctggtcagaacttcgtaaaacggaatcactgccacaacatcgatatccgcttcggcaacacgcacgatatgtgtttcatcttcttcgtgaaggccgattacaagccctcctgcaagggaagcagcggcattatcagggtgcccctcttcaagactggctaagtgcagcttgtcgctttccgacagctgcaggccgcataactcatccgcaagctcaatggcggcgacgatagcggccgcgctgcttccgagaccccgcgcaagggggatgtcactccaaactttgacatgggcgggcggcagctctttctgatagcggtcagccgtccgtttggcgacttggtagatgaggttgtccgttccttgagggatgcccgcgacagtttcggtttccgccgagaactgccattcatcgtttcggaaaaccgaaagcttcaaatatctgctgagcgccattccgatggaatcaaacccaggtcctaagttggcggtgcttcccggaaccgtaatggaaaacagcatctccgcctcattcatacacgcgccgctccatttaagtattccagaatactgtcctcatctgtcggcagcgtgatcggttttatgtcagatacgtccacagccgtattcggatctttcaggccgtttccggtcaaaactgcgacaaccttgcttccttttggaatttcaccggatttcacctgtttcaaaacgccggcgatggatgcacaggagcccggctcggcaaatacgccttcttcacgggcaatcagctgataagcgtgaaggatttctccatctgtgacttcatcaatttttccggctgattcttccgcagcgagcacggctttgtcccagctggcaggattcccgatccggattgccgtcgcaacggtttctggatttttaatgacttcgccgcggacgatagccgcagaaccttccgcttcaaaaccgcgcatcttcggaagtccggtgccgtttttctcatgatattctttgaaccctttccagtaggccgtgatattcccggcatttcctaccgggatcgccagaatgtccggcgcttcgccgagctgttcgcatacttcaaaggccgctgttttttgcccttcaatccggtaagggtttactgaattcactaatgcaatcggtgatttttcacaaatcgaccggacgatggccagcgcgtcgtcaaagtttccgtcaatcgcgatgatttccgcaccgtacatgacggcctgcgcaagctttccgaaggcgattttcccgtccgggatgatgacgatgcatttcatgccggctctcgccgcgtatgcggcagccgcagcggatgtgttgcctgttgaggcgcacatgatggtatcattgccttcttctttcgctttggcgaccgccatgaccatgccgcggtctttaaaagatcccgtcggattaacgccttctgttttcacatgcagttcaattccgagcttttcagaaagcttcgggaggtgaatcagcggcgtgttgccttcatgcaatgtcagggccggcgtccgatccgtcaccggcagaaattctttatattgatggatgagtcctttccacattagctccaaccgttcccttctacacgatatgtgctttttacttcttgtacaacttctagatcatttaagttttgcagaatgtcactgaaatcttcttccgatgtatgatgcgtgacgatgacgatttccgcgagatcgtcatgtccttttatcggcagctgcagaattttttcaaagctgacgccgcgctctgagaaggccgatgtgatttttgaaaaagagcccacctggtctttgacatgaattcttaaaaactgctgggcgtagatatcagacggctgcttcagatttctttcaaactgcggggcgacaaagctgtttccgtttacgccgagacgcatgtttttcatgaccgcgaccagatcggaaacgactgatgtcgcagtcggcatgcttccggctccggggccgtaaaacatcgtttcgcctacggcttctccgtacacgtaaacggcattaaactcgttatgcacggcagagagcggatgatgatccgggagcagtgtcggctgaacgctgacttcgattttattgtcatcacgctgggcgatgccgatcagcttcatcgtatagccgagccgtttgctgaagctgatgtcttcatccgtaatccgggaaattccttttaccttgacatcgtccagatcgacgttcatagagaagccgagacgggctaaaatcgccatcttgcgtgcggcatcgagtccttctacatcggcggtcgggtccgcttccgcgaatccgagatcctgcgcttccttcagcacttcttcatacgggcttttttctttaatcattttcgttaagatgaagttcgtcgttccgttgacgattcccatcatttttgtgatccggtcagaggaaaggccttcttcgagcgtgcgtaaaatcgggattccgccggcgacactcgcttcataatacaagtcacagccattttcctttgcggcggctaaaagctctgacccgtatacggcgatcagatctttatttgcggtcacaacatgttttttcgctttcaaggcatcaagaagatattgcttcgtctgttcgacaccgccgatgacttcaataatcacgtcgacctcagggtcatcgatcacatcatagacttctgtcgtcagcacttctttcggcaggtctgcgtctcgttttttatcaatatctttaaccagcacttttttaatcgtcaccggacagccgacctggtgcataagcttatcctgatgatcttgtataattttgacgactccgcttcccacggttcccagtcctaacagtccaatacgaatcgcttccaaagagaaactccacctttcttccttttgtccactagaaaaggacaattgttaacccttcacagacatttaagttacaaatattatataagcccgcatttgttttgacaagcggctgaatattgtttctacggccatgaaaacgcttaacacattgatatgacaagattccctattttctaaatatttttacgttatattttcttacgaactgattccttttccgagccacgccacaggcgggacaaaaacctgcgccgacctgacattcatcatgtcgtgacatgtctgtaaaaactgttcatagcgggtgcagtcggcaagaatgtagtcaagctgctcttcgtaaaactgtttttcagaatcatgagaaatgtaataactctccaccgtctcaaagaaatgaagcggaaacagcaggcggctgtaaaacaggcgcttggaaaaggaggataacggcgtaacttgctcatattcctgcaaaaacaaaaacccttcgttaagcaagtcgtcacgatgatacaaatatgtgctgcgcatatattccgcaatatcacgggcggcatggtcgaatacccaatcgcccggaatgcggatcaatgattcctccgaccaggtatcccgttccatccgctgatggcagattgtccccgagtcttctgcgccgggattgtcatccagctccgtatccactaaatattgaatcgcattttccgctaagcctgaataataaggaaatgcttcgatcattttcttttcgaacggttcaagcggagacatatgaattttctgcatccagaatgattccagctgatccacccgttttccccataagtccttccattggccgatcctgcccgcttctttcacttcgtacggaaaaccccgcccttttctgtgaaattcggcaagctcccctccgacagagaacgaccggtttgcgacggggatcggcgcttttaagagcgcatacgttttgccttcgtcctcaaaggtcagttctccttccttcgtaaagataaacactgaaacgtatgggtcactttgttcttgtaaatactgactcatgtagtaaagctccgtcagctctgattgcgaaaacccggaaacgggaataataagaaagaaggaattaggcgtctggaagcattggtatttctgataaacggaaagctgtctgacgtggatgccgtacttttctttaatgatgcttttcatcataatcacctgcctgaaaaattagagctattcacatcgtagtcatacgccggcggaattatgaatacatattgtaatcctttgaatcaagtggagaaacatcgtacacatcggaagggtgttgtataaactagtaaaaaaagattgggtgaagcaaatgtcagaaaaggaacaactgaatcaggtggaagctgtcgccagagcgcgtttaaaagaacgggggttgagacggacgatattgccgagctggtgtatttccttcagaaaaaatatcatcctgatttgacgatggaagtatgcaggctcaatgtggaccgtgtcatcgcaaaacgcgaggtgcaaaacgccattttaacgggaatagaattagatgtgctcgccgaacaaaaaaaactgtctgaaccgcttcagaccattctggcgattgatgaaagcctgtatggggttgacgaggtgctcgccttctctatcgtgaatatatacggctcaatcggctttacgaattacggctacattgacaaagaaaaacccggcattctcgggcggttaaatgataaatctacgggggaatgccatacgtttcttgatgatatcgtcggcgcaatcgcagcagcggcttcaagccggcttgcccacagcgccagaaatacagaataaggacggccgtcatggccgtcccttttttatagatgttcaatccattcggttaaagagtcaatcgcatatgtcggcttccggtcgtaatctgccatatgctcacgctttgtcactccggtatgaaccagcagcgtatccatgcccgcattgaggccggccataatatccgttgcatagttatcgccgaccatgagtgtttcggaaatatccgttccgagcacacgcatcgcctgttccataataatggattcaggcttgccgataaagacaggctcaacgcccgttgacaccgtcaaaacggatgtgagcgaaccgttccctggtaaaagccctctttcagtcggaatggcgacgtcgccgtttgttgaaatgaaccgggcgccgtttctgatcgcaaggcatcccgttgccaacttttcatatgtaatgccgcggtcgattcccacaacgacaaagtccgcgttttcttctccgaagctcagcccgttttcttcaatggcctggcggatgccttcttcgccgatcacatacaccgacgcgtcttttttctgctgggcgatatgctgcgcagtcgccatgctcgtcgtgaagacctgctcttcagttgccggaatgtcaaagctcatcagcttgtccgccacctgcttcggcgtccgggaagaattgttcgtcacgaataaatacggaatgccgcgcgctttaagcgttctcacgaattcacacgcttcttcgattttttccgtcccgttgtacattgtgccgtccaaatctatcaaatatcctttataatccttcatactcaacactcctgtggattttctcactcgttgttatttaaatgcggaaacaggccctaattctgtttccaggtaggttcttacacgggccggaaaggctttcagcacgtccctgtttgacgtgatcagcgtaaacagctcctgatgatcggcttgctgatattcctgaacaagccgctttctggaagagatcagctgcttgagcttattcgcttcatcctcagctaccaccttttcatccgtcagaatatccatgatgtcgtcataactccccggatcgcgcatgataaagccgtcaatcatatcatttccgacatcgagaatgcattcgatcataagatggctgatccgctcaagcgcccttttttcgatttcgctctgccatgcaggcgtgctgtcaaacagcgccagctgggtctcaaaaaaacggagtgtttgttcgatattatttctgtcaacaaaatacacgtgacagcatccccttctgcatcaattattttctgattcgttttaaaacaaaatacgcgcagccgaaattgcagtattcgtaaatgtattcgtccaatgtgctgattttcgtttcaaaggttgctttttgattctggtcatcaaagaagcctttgagccgcagctgactgtatccccagtctcccacaatgtaatcatatttatttaatatgtccgaatagcgggctttgaacgcttcttcattaaagccgtttttaaaatcgtgtacgagttcaaactcggcattttgaataagaatcatgtcttcacctcttttatcactctttactatcataattcattgacttctgtccatcaattgcaaaatgagacggttcggacggacggaaaaattttccccttttatatccagtgtagcggttctgacgatccttattcaagaatgactttttccctgcacagacggctccatcacaaaaaacccaaaacctgcggcgttttgggttttttcggcttatcttatgcttgggcctggcgttttttagacgcttcgttcacttgttcatccgcatgataggaagaacggacaagcgggcctgcttcacagtggctgaagcctttttgcatcgcgatttctttcagttcggcaaattcgtccggatgataatatttttggacttttaaatgttttttcgacggctgcaggtattggccgatcgccatgatgtcgacattgttcgcaagcaggtcgtccatcacttcaataatttcttccttcgtttcgccgagaccgatcataatgcttgatttcgtcgggatgtcaggctgcatttctttcgcacggcgcaagaattccaaagaacggtcatatgttgcgcgggcccggactctcggtgtcaggcggcggacggtttcaatgttgtggttcagaatatcaggacgggtatccattaatgttttcaggttgtcgtaatttccgcccatatcggatggcagcacttcaattgtcgtgaacgggctttttctgcggatcgcccggaccgtttccgcaaagacgcctgctccgccgtctttctgatcatcacgcgccacggccgtgatgacggcgtgctttaagttcatcagtgcaaccgaatcagctacgcgttccggttcctgcagatccagctcagtcggcagacccgttttgacagcgcagaagcggcatgctctcgtacagacggaaccgagaatcatgaacgtcgccgtacgtctgacagcccagcattcatggatgttcgggcattttgcttcttcacatacggtatgcagattattttcacgcattaattttttcagacccgtatagttttcattcgtgttcagctttattttgagccattccggctttctcagatgctcgtctttctttgccatttccccatcatctccattatccctttattcatgttcgtgtgcgaaaaatttctatttcacgatggatataaaacttgcagatttctattcaatagtcactttaacataggaaaaatttctcgacaagggaagagaattacttacattttctcggattgttgccgcaaactagttgtattaatcctgaaaggagatcatgttgtgaaagttctgttatctgctcttctccttttatcagttttctgtccggctgcaagcgggaaagaacaatcggctcctgtttacggtgaacggatgcagttgtaccgcaaagccgaagcagtcacgcagattccttggtatgtgcttgcggcggttgatcaatatgaagaaaatgtccgctcgaaccgaaaggatctgccggaaaaagcgggaatcatcagcatttatattccggatcatttgtggagcgggcctgaaaatccaaatcctaaggacgaggcgcccctcagcattaaagtatttgacgggatcggcctggacggcgacggcgacggaaaagccgaggtcagcaatgatgaggatatcctttatacatttgcacagtatttagcgggattcggaacggatcttgaccatatccgcatcggcctctggaattattaccgccgtgatcagacggtcggcattatcaccgaattcatgacactgtttaaaacgttcggccgccttgatctcggagagcacgcttttccgcttcccgtgaagacggattacagctaccgcagcacatggggcgccgcacggggtttcggcgggcgccggattcacgaaggaacggatctgttcgctcattacggactccccgtcagatcgacctgctacggtattgttgaaatgaagggctggaaccgtttcggcggctggagaatcggcatcagggatatcaataacacgtatcactacttcgctcacctgaacggctttgcaaaaggtgtgcataaaggccagatcgtcaaacccggagaggtgatcggctctgtcggcagttccggatacggaccgccgggcaccgcgggaaaatttccgccgcatcttcactacgggatgtataaagataacggcagatcggaatggtcttttgacccgtatccccatttaagggcatgggagcgaaaagaaatccgcaggaaaaagtaaacacacagccgccaggaaagattgcggctgtgtgtttttatttatctttcttctgtttttcactcggcagctggacagaaggcgtcacacctgatccgccgcttccgttataaaactgcggcacctctccttgaatcgctttaatggagaccggaatattatttgtgacgactgatgtcttactggcaaacggaataatgaccttcactttaatttccacaaaaatactgatatcgatcagggcattgttaatgccgtacggctttatttttgttttcacatcagttaacgcatcaccgatcaggttaaagcgcacggggattttcggccccagatttccgagaacgctgtttcccgtgacctgccctaaagggatgttaatcataatttcatcggccgttttcgcgcctttttccgtttcatgctgcttattgttcgactccgcttccttcaaatgagcctgaagctgctttgtcactttcgccttcatgctgttgaccatttgtgtattaaaatccatcgttgtgacttttccgttttcatccgttttcatatcgaccatatctttcacattgtcgctgtgagacatgtattcttcaatggattccgtaatgacctctgtcgccacccgtttggtttccatttctcctatgttcatcagcaccggtttgattgaggagttgatcatccagaggctgatgaccgtcgatatgataaaaaaagcaaacgacagaagaagcacatatcgaaaaggcaaaggccctctcttgcgaagagcgctccggtatctaggcaagaaaaatcccccttacatatcacaatgtatgcttgtaagaggggacatagtattttatttttgctcttaaaaagtcccgcttaccttcattcgggtgagatggaacggccggcggatatttgacattacgcttgccgcgcgagcttccaggcgagcagatcccttaaaaactccggcataaaatattgtttttcttttgaatcgcggatgtaagggaacagctttccgagtgtaaacatgtcgagaacggcaaccgagtatatccgctccggatccacctcttctccgttcactttcacattgaggagatgcgtcacaccgtcttcaaggatgccggcctctgcctccgctccggcatataccatcctgcccatcacttccccgcggaagccgaggcctttaatccgcagctgctccatttgttccgaggcggcctggctgattgtttcccggagttccctgcctgaaagacgaacggcgaccggattgatcggatgagggcagatgcggtgcaagtcaagttttgtgacaggccccttctgtaaaggccccaaaatgacgcctgaattcaccatgctgacttcacagccgcaccagcttttcagcgcttcggctaatagaagcgggagcggcgattcctcaaaccacttcacgccggcttcttcattcagattggcgacttgtacggagagcaggttttccgcttcccgttctttctctttcagaaaagccgccgtatcttcagattccccgtgccaatcagccattttctgtacagatgcctgtttgctgacaatggttcgtgattcactttctatcgtcagctcgacacagccgacatagttcccgtatttctccgcacatgcaagcaatacgccgtttatatcctgtccgtcctcaagaaggtggtgcgtatgtgattcaagaatgacatcgatgtcgggaaatttttccgctgcggcccggtcatcgatcaggcctaaatgagaaagcagaatgatgatgtccgctttgcccttgatatcgtcaagtgattcttgaatgcttttttccgcatccgtcaccgtccagccgagtttctgatagacgggataatacggcaccgtgaccccgagtatgccggcggtcatcccgtttttcagcgttttgatcacgtagggctcggcccattccggccgctgtccgtccgcgtcaaacaggttggacacaatgacgggaaacgcggcatgagtatataaacccgccagctcatcgtgaggcagcgtaattccttcattattcccgacggcagccgcattgatctcaagccggtttaacaagtcgacattcgctttgccgaaggtcgcttccgttatcatttgaaatcggtccatatgatcgccgatgtcgaatacgagtgtttcctccccgtttttttcatgctcttttctcttctgctcaatataatgtacgattttcggccaattttcgaaatggctgtgcaaatcattcgtatgatataaacggagtttctctaacataccatctctcctaccttttagctgaatatcccttgataaatcaattcacagccgatcaaaatcaagacgacccgcatgaaaagcacgatcgttttcgtctgcacccgcttattgacccacgcgcccattttcccgccgaaccacgcgcccggaacgaggcacagcgcatacagccaattgacatggccctctgcgatatgtgacacggaacccgtcacggaggataagaaaatgatgagcattgacgtcgccacagccactttcggcgggaacaaaaataacagcatcatggccggaaccataagagagccgccgccgatgccgaaaagaccgcccaataaaccgacgaaaaaggcaatggcgataccggtaaaaatacggtacgaatatgtataaagctcacccgtttcatcctcatatgtccggatcatgcctttatgcgctttattgaccggttttgctttcgccttcagcattaatgtaatagaaatcaaaatcataaaaagtccgaaccagacggaaaacgtatgcgcattaaaaagtttagacaaatacgcgccgatgatgcttcccgggccggaaccgataaaaaagatcagtccgcttttgtagtcaacggttttatatttcatataggccagagttgatgacaggcccgtaaaaataatcaccaaaagggacgtgccgatggcagtctgcggtgttacgtcatggaaaaacggggtcatcgtgcttaaatagagcatcgccggcacgatgataattcctcccccaagcccgatcaggctgccgaccgttcccgcgataaatcccaatataatcaaaataagataagacatgtgtcttgaaacctcttttctagctgaataggtcgagctgcttcggagcaagcccggtatatgagatatctaacatttcaagcatctcaagcccgttatcggcggcgtctccgcctgagttattgttgaagagcacatacagattgcgcgactgctttttcagctcctgaagattgtttttccaatctttgagctcctgtttgttatagcggtataaatatctgacctcacgccagttttgtccgccgtcaggtttgatccagccctgcttgttccgtccatgaaaacggacaagcgttttttcttcatccgttgctttcaggacggtcggaatgctgccctcgccgatttgcggctcgtcacatatgctgtgaatccagccttcctccttcataaaggaaagcgtctgttcgtaaaatggcggggaaaaccaagatcggttgcggaattcaagcgcgcacgggatatcgcccatctgcttcctgcaccatcttaaatatgcgacgttttctttcttgcagtcaaaccacggcgggaattggaacagcaccatggcaagctttccatgctctatatacggcgataatgacagcttaaacgcctcaaacatttcttccttcgattcaaagggaatatcaccgcgctgatggcccgtcattccttgaaatgccttaatgacaaattgaaaagattccggcgtctctttgacccatctttcgttattgcgggcgggctgtatcgcgtaaaagctcgcgtccagctcaacgatgggaaaatgggaggaatacgcctgcagtttttgcgggcccgctgttttaggcggatagatgctgtcatgatccccccaccccgtcagtccgatataaatcacaatccttcacctctcattctagtttatcacaggtgtttttctctttccgtttccatgttttttctgaatgcactttgcaggtaacggtactgatgttcattggtgtccgaaaatgcctcatctctggaagaaagaatatgctgatagacgatcggctctgaaaactgaccgctcgtgaaatcatatatctccccgtctattcgattataaaaatgccagcttgtgccggtttttgttttgagaatgtcaccgccgtaaacatcttggatgactaaagccgtcacgccgcactggcctgtggccgggcaatcttccgtccattttgtactggtcttgcgcgaccaggatgccgttaatatgttcaagatttgatcatacaatgtgttttactcctttttataaaaagataccacgagacccgctttccaaacgacaaaaaaagccgattctcatcagagaatcggcttttttatttcacaaggcttcaggaatgttccgaaagacccgctctgcttacgaccgccatcctgatacacacagcaccccttgctgtaggtcgcagcaattcggtatggaaaggtgcggccttcatacaggctttgcttatgtttggaaaacatcgtttcttttgtgacggtaaaaggttccggccggacaatggcaaaatcagcgtcaaatccttcttcaagccggcctttattcgttaaaccgaaacgcttggcaggtgcttcggccgtccatcgggccacatgttcaaacggaatcccatgatcgatcgctaattgaatcatgccgagaagcgtaaattggcctccgctgatcccgccccacgacaggaacatattatcctcgcgtttcaaagccggatgacagggagaatgatccgaagacaccatatcaatcaggtcttcagccaaaaccccgatcaattcctctttatcagcctctgagcggagcggcggagcgcatttggcagccgccccttttttgaggaagtcttcaaagctgaataataagtagtgcggacacgtttcaacggtgacatccaatccgtcttttttcgcctgctgaatggagagcacggcccgtttcgtgctgatatgtacaaaatgaagcgcgcatcccgtcgctcttgcatattcaatcgcccgctgcacagcctcgcattcggcttcttccggacgggaggaagcgtaagcgcgggcatcaattttcccttggagcgcgtactcggcttcaaggaatcgggtgagggcgtcgctttctgcgtgcagggccaaaatcctgccgcacgccgcgatttccttcattccctttaaaagagtccgttcatcggctgattgaaattcatccgttcccgatttagacagaaacgctttaaacccgattgcccccgcttctgccatcggccggatatgttcggtatacccgggcatcaaaccgccccaaagcgcaaaatcaaccgctgacttccgttcggcgatttccgcctttgccagcaggttttcagcagttaccgtcgaaggaatgcagttaagcggcatgtcaaaataagccgtacagccgccggcagcaagcatgtttgagccggtttcaatgccttcccattcttcgcgtccgggttcattgaaatgcacgtgacaatcgaccgcgcccggaaacacatacatgccgtctgcctgcaccacttgttccgcgttttcgtcaatgccgggctcgatcaatgcaattttcccgtccttgacggcgatatcggcccgctctgtcccgccttttcgcacagctttcgcaccctttacaattacgtcataggccattttatcttcctccctgtaaggatgacgattttctgtcagtttttatcacaacatgcgtctatgattgccagtttactgctactatgatcgtaatacatcagcaaaaccgctataatttttgatgacttttattcatattaaccaatggttgtctttagaacctgaaaggagattgactgatgaatatttatgatgtgatgaagattcccgcttatgagcgggccgcattaatcgcaggcagatccggcggctggagggaggtgcagcacgtcaacatgatggatgcgccggacatcgctgattttttacataaaaacgaattgctcgtcacgacggcttaccacttgaaggaccgcccgcagctgttgaaagatttaatccgcctcatggcaaaacggggatgcgcgggactggggatcaaaacgaagcgctatcttaatgtcattccgaaagatgccgcagagcttgccgaccggtatgaatttccgattattgagctgccggaagacatcaggctgggagatatcgtcaatgctacattgagccatattcttgatatgcgttcaaatgagctgcagcaggccatttacgcccataaaaaatttacaaaccacatcatgagcggcaaagggctgcaatccctgcttaagaagctctcagacattctccggcttcccgtgctgcttttggatcagcatacaaaactcttatcatcgtcccacagcatacccattgacacgtctttattgaaaaacatctgttattccctttccggtccttatttcacctgcttttccatgctctccgacagaaaggtgtattctgtcctgccgattctgaatgttgaaaaaaactgcggttatctggtgattccggagctggtgcagaccgctgataaaggcatgattttgacaattgaacaggcggccaacgtcatttcctttgaactgctgaaagaaaatgccgtcaaacaattcggcagacgggcgcgcaatgaatttttcagcaatttcatcgaccgctcgtttaccggccatgaagaaatcaaaagccgtgccaaagaattccggctccgctgggatcagaaatacatgtgcatttgcggaaaactcgaccgaaatgagaaaacgatcagctttaccgaaaatcagctcgtttccgatcatgtatttgatctgcttgaaggggagctgtcatcctttccgtttccccctcatctctttattaaaggaaatgtcggtattcttttaattgaagcgacagacagctggaatgaaatgcacgcgtctgtcatcagctttttggagcagtttcagaaacaggtccggacgcagtttaaacggactgtctccttcggcatctcaaacatatgccaaaagctgatcgatgtccctgacgcttttactgaagcttcagacgccatttcatccgggcatttgtccagaagcgcggagtttattcaaatctatcatgccaaagacgtgccggagttgctcggcctgcttccggcggaagatgtgaaaaagttttacgaagccaccctccaaagcctggccgaccggcaaaaggaggaccagagcctgcttcatacactgtctgtttacctggaaacccactgccagatttcagaaacggctaagcgcctgtacgtccatcgaaatacggtgatctatcgtttagaaaaatgcgaggaactgctcggcaaaagcttaaaagatccggagacgacgatgcgcctgcggctcgcgctgagaatgcagcggctgatcggttaaaatttagccatagaccaggatgcgggtgttctcccgcatcctatttaagggggattcattcagctaaaccctcaaaaaatgctgccattgatatcatcaggctttttcgatattcaggatgcaaccgataatctcaccctttttgatttcatcctaaactgcctcggaacctttgtcacaagcacccatgacccttttttgatggtttcgccattcatttgaaaatcagcggggagcgacacaagactcaaccacttccccacgccgccctgaaagtcatgctgcttttccttttctgatttcataaaaaaaccgcttttgattagcagccttatctacgtaagaaacatgtatgatgtttgcatttatcaattcacttggcatgtgttcactcatttcaaagaatatttaacaatttcttcattgttatatttccattaagtgttactgttatcctataaataccaaaaggaggttttacgttgaaactagctaaaaatgctttgttatcacttgcaattgtttcattcgttttcgcgcctttttttaactcttcagcatcagccgccggtccctctactaaagtgaataagaatttgtttcaatctcagtctgaaacccgcgtcaatttaaaagtaggagagataaggaattattctacttctggtaatcgcatttcctttaatcctacgggttataaccctcctgctgtgacatggagagctttaggtactgactacaaaaccattcaggtatttgcagtcgctaaaggagaagcctggattgaattctatgatgattcctccacttggaaaacccgataccattttgtagttcagtaataatccgaagagatagattctatctcttctttttaattaaacgattgcgacgttttgaattttttatttttcctcaactgacagccccaaaatctcgttatctactacaggagacagaacgcagtgacaatgaacccgctcagcggcggaaagctttgtgtctcgcggatacatacaggtttcgctgcttcctggtatcttgaattcttcgtcaacaccaacagtcgaacacatcaagaccaaaaaccgcttctgacaggccgcgcaaggggattttataaaatttctgaaaaaggaggggcgcttcccctccgtgaaccgtaataaagcttcgtgtgttggctaatggctgtctggataatggtctcactgtcatcctggaaagatcacttacttctataagtctttctttttaacagaaaccgcagatatagcagcagaaataactatccgctccgcttcttatgcactctctgtaacatggggaattataaaaaggagggcgcgcggaaacatagggggagccccctgaatgagtcaattgatgggcccatggataataattaaattcttgccgctgatacaaatggaatgacgggtaataatacaacattttcaactccttttccgtacaccatattgtacttaccgacatcctttttagatgattgtctcttgcataattgtgtgttggcctaattgcgggttttaatctgcaaaattcatgcaggagaaccatcacaacatcttccgggagaggttttataagataacctctccttgttgtcaccaatcgccccctactgaacagttcgtattatttcaatgacccgttttatcagaatgctctccccctgcatacgaaacagcaagttccaaaaccctgctttttccttctcagcatttacgccgctcaatgttgtccctgcctgcctgactgccttcttttttgatcaacttccggcagatcaaattcatcagactcgtcaagcgataaagctggttttactttatctacacctgttccggtttccattcgcgccatgcttgagcatacggaacaactgtttttgctatatgattttccctctatgcgcatctctgcaatttcagagatgcagacagccgcagaataaacgacaatcagcaaaaagcctccggatacccggaggcttttgattcttatccttgctgcgtgaacggccgggtctgtgtctttttgccccagccaagcgcggccagaaaactgatggcgagaatggccgctcccagcatatacggaaattccatatttacatcaaagagaaaaccggcggccgacggcccggcgatattcgctaagctgatgaatgaggtgttcatcccgccggcaaacccctgctggtcaccggcgagcttcgacagcatcgtattaacggccggccggagcagcgatgtcagcgtcaggaaaaagattgccgcggcaaaaacggcccaatatgaacccgcaaaccggcaccacacaagtcctgcagcagccccgatcaacgtcacgttaatgacgcgcttttccccgaacctgcggacgagataactgacgccgaccgcctgcacaaatacgccgatgagacccgcagccgtaataataaaggcaatatcagaggctttaaatccgtgtttatggtcaacgtaaaggccgaaaacggattcaaagttcataattccgaagttcagcacaaaaaccagaatcagcataaacgcgaacggcgatttgagcgcgcgtgacatttgcttaaacagatgctcacgtttttccgtttttgcccgggcttccagctgcttttcacgccccagcgtttcgggcagaaagaaaaatgaaagcaccgttgaaaagcaggcgagacttgcggacacgatgaacggcacagacatgccgtaatgaaccaaataaccgccgacaccgggcccgatgacgacaccgagcgtcatcgccgcgctgaacagccccattcctttcccgcgttcttcctcggtcgtaatatccgcaatgtaagcgaacattgacggcattaaaaacgccgcgcccattccgcccaaaaggcgggatgcgaacaattgccacaggcttccggcaaaggcgaagatcaattgtgacacggcaaaggcggcaatgccgaaaataatcagtttccgccgtccgtatttgtcggttatttccccggcaataggcgcaaataaaagctgtgtaagccccgccgccgcaacaagcagacccatcgtgctccccgtcgctccgaattcggtaatatatgcgggcataatcggaataatcaatccgatcccaagcatcgcaataaacatattcagcattaaaattgacaatcgccccatgtacgccatgatttcttaccttctccccagacaaacagatgatcattccatatttgtcattttttataccattcagtataacggggaaaagggaaaaaagtccagatgatttcaatctcgttttcatatctcatgacagcataccggtttcagccggcagatcatatatgttaagggccgcctgcagcgcttccccggctttaactgcaactccgtgtctgatcagaaccgcttcaagtccggccagcacaaacagcacattttcctttctgcagctgtagcccatcgttccgattctccaaattttcccctgcagcggaccgaacgaactggcgatttcaattccgaattgagacaaaagcatactccttatcgattcgccgtctgcttccggcggaatcttcacacatgtgacgacaggcagcttcgcctccggatcgccgaataaatcaaggcccattgctgcaagtcccgccgtaagcgctttttcatggcgctgatgcctgcggaaccgttcttcaagtccttcttccagaacaaggcgcacaccctcccgcagcgcataaagcattgctgtcgcttctgtatggtgattcagccttctttcactccaataatcttcgagctggctcagatcaaaatagttgctcgtaaccggccgatgaccggacagcattttaccgtcagctgctgtcgcaatgccccgttctacctttttacgcgcggcaatgacagcggccgtccggtcattataagtaatcggcgccattccggaagggaccgataggcatttttgcgttcccccgatgactgcgtcaatcttccattcatccgtttttacggcgcatccgccaatcgtggccacggcatccacgataaagagtgcatcttgggcgcggcacgcttccccgatttctttcagcggatgaatccgccccgttgatgtttctccgtgcaccatagcgacgattttcggggaaatctttttcatctcgccgataatctcttcaggccggaagaccgttccccattcacactcgatcgtatgaacgtccgctccgtaccgctcggcgatttcagtcagcaggtgtccgaagcgtccgtatatcggaacgagcacgctgtcgccaggttctatcacacttgcgagaacagcctcaatccccgctcttgatgtgccgtcaatcggataggcccagcggttttccgtttgaaacaattcacggagcatttgcatcgtttcgttcatgataccggtaaatgccgggtcaaactggccgaggatcggagcgcccatcgccctcagcactctcggttcagcttctgtcggtcccggtgtcattatcgttctttgcggaatgcacaattcttttctggtcggcacgccgattccccctttacgttaataagcaagtttatgtaatacattcgccagcgtaaggacgccggtttcaagctgatgtgcgggtgtgaattcaagcggcgagtggctgatcccgccacggctcggcacaaaaagcatgcaggccggaaaggttctgccgagcatctgggcgtcatgtcccgctccgcttacgatcttctccgggtccgccccctgctcttttgcagcctgtgctgcggttcgtgtcagtatgtgatccatttgaaccggctctatcctcatatattcatcaataaagggtctgactcctttgctgcggctgatgttttcaataatcgacaccagtttctgatggaaggctgccagcacgtcttcctgctggtggcgaatatcaacggaaaactggatacggcccggaatgacattcgccatattcggctcaaccgtcattttcccgcacgtcaggcggagctcttccggctgtctttccgctgagagcatgagttcatggatgatgctgcttcccgccgcgagcggatctttccgccatttcattgaagtggtccccgcatggttgcattcaccgtcaagcgtaacggtatagcgtctctgtccggcaatcccggtgacaatcccgatatcctttcccgatcgttcaagcgtttgcccctgttctatatgaatttccagaaaggcactaatatcagtgcgcagcggcgccggataacggcctgcaccgaagccgttctgccgcatggcttctttcagagaaatgccggacgcgtctttcggcgtttccgcatctgaaagcgagaaagcaccggtgatattgcctgagccccaataggtgatgggaaaacggctcccttcctcttcacagagcgacacagcctccagcgtttttttcggacgcccgcacgtctcatgcaaatgccggatcgccagcatgcccgccagcacgccgaacgcaccgtcatatttgccgccgtcaataacggtgtcaatatgcgacccggtcagaatcacctcatcaggcgattctgtgccgctcagacggccgaacacgttaccgacatcgtcaaatgccgtttccagcccgaacgcctccattttctttttgacggcaagctgggcgtccatccattctttcgtatataaaagcctcgtcactccgccggaagcggaagcgccgaattgagacagccattgtatgtcatcggaaatcccgatattcgccgccgaaagctgctgatgttccatatatgccctccttttaaactgaaaaactgacaagatgatcttcattatagaaggagcgcataacgagttcattatcatatcttccaaaaaatcaatgattttccggatactttgaccaagaaaccgcccctctgtcccataagccgaaggaaccatttttcaaaaaagatagaatattagatttattttttggataatagaggtaaaggagggcaagtcatgacaaaaaaactttggtttctgccgattgtctgcctgtttttcattttgggttggaccgcgccgtcagcctctgcgggcgcgccggctgacacgaatctgtacagccggctggcggtttcaactgccggcggcacaactctttttccgcaaacttcctcagctgtcatcactccgtctgcggatacggagacatattacaaagaagcttccggaaaaagcggaacagccttaaagagcgccctgcaccgcatcatcagcggacatacaaagctgtcttacagccaagtatggaatgcattgaaggaaactgacgaagatccggcaaacccgaacaatgtcatcttgctctacacccaggaatcacgggccaaaagtaaaaacggcggcagcgtcggggactggaaccgtgaacacgtgtgggcaaagtcacacggaaacttcggaacagctgccggccccgggacggacattcatcatctgcgccctgcagacgtccaggtgaacagcgccagaggaaacatggattttgataacggcggctcagaatacccgaaagcgccgggcaattattatgacggtgattcctgggagccgcgcgatgaggtcaaaggagacgtcgcccgcatgctgttttacatggcggtgcgttatgaaggcggcgacgggtatcccgaccttgagctgaatgataaaaccggaaacggctcagctccttacatgggaaaactgtccgttttgctcaaatggaataaacaagaccccgtcgacagtaaggaaaaacggcggaacgaaatcatttacgaagactatcagcataaccgcaatccgtttatcgaccacccggaatgggcggacgaaatctggtaatcgtatcataagaagtgataagggagccccatcatcaggctccctttttcaatatacggcgttttcagtgtcggcatcaaaaaacacggcccggttcatattgaccgcaagcagaatggcatcgccgggtttcacctctgaagcgccgtcaaggcggatcgtcatgcggtcatctccgctcaccgcatgaacgtacatctccgcgcctaagttctcacatacttccgccacagcgcggcacaccgcttcaggcgggtgctctgattgtccggcaagcgtcaaatgctccggacgcagccccgcagtcatctcctgaccgctgtatcctttctgcacaagaacggccgctttttctttcggaatgggcagacgaacggacgaaccggcaaaataccattgcccgtgactttcttctatgacgccttttataaaattcatactcggagaaccgataaaacccgccacaaacatattcgccggataatgataaatctcatgggggcttgcggcctgctgaatatttccttcattcatgacgacaatccggtcacccattgtcatcgcttccgtctgatcatgcgtcacataaacgatggtcgctttcaaacgctgatggagcttgctgatttcggcgcgcatcgtcacacgcagtttcgcatctaagttggaaagcggctcgtccatcagaaacactttcggctcccgcacgatcgaccggccgagcgcaacccgctgccgctgtccgcctgaaagagccttcggtttccgcttgagcagatgcccgatttccaaaatatcagcggccgtccggactcgctctgcgatttcttttttcggcagctttctgagcttcaaaccgaacgccatattatcaaacaccgtcatgtggggatacagcgcgtaattctgaaaaaccattgcgatatcacgatccttcgggggcagatcgttcaccgcgtctccatcgatataaagcttcccttcagaaatgctctccagtccggcaatcattctgagtgtcgtagatttgccgcagccggagggaccgacaagcaccagcagctcctcatcctttacatctaagtgaaaatccttcactgccgccgattgggcgccgtatgtttttttgatatggtcaaatgttaatgatgccattcgaaacctcctccaatactggaaaccgccacatctttctgttatgttaaaaatgttcggggtttctgacagattcataaatgaaaggcaaatttgtattataacatcataatacatataatagtactactacttgacaaaggaggtccgtcccattgttaaataacgggagctcgaaacctttatatattcagctgaaacaaattatcgcggacgatatcaagaagggcgtttattcgccgtccgtaaaactgccgactgaaaatgagctgtgcgaaacgtacaacgtcagccgcataacagtcaggaaggccatccttgatcttgtggaagaaggctggctcgtccggcagcagggaaagggaacgttcgttaaaagccctaaactgaagcgggagctcatcgcggtcaacggctactctgaatttatggaatcaacgggaaaaaaaccgaaacaccagatcctttcccatgaaatcattgaagcgcctaaatccatcgctcaaaaacttcgcgtcgcttccgaaagtcccgttcttgaattaaaacgcattttatttcacgacgaccagccgctctcattcgaaatcgcccactatccgctcagtttatttcccgacatcggcaagcatattaaaggcggcgtgtcgatgcatgacattttgaaacagcactatcaggtggtgcccacccataatacgaaactgttaaatgtcgtatacgccaagcaggaagaaagccgctatctggcttgtgatatcggggatgcgctttttgaaattgacaaaaccgcttttatgtcaaaagaacagccgatatacagttcgctgtttttaatgcataccgaccgcgtcacgtttaccattaacagcccctatgcgtaacaagtataaaaaacgagacaatgcttatcgtattctcgttttttcactgcttttcccgccgtccggcctgtagggatgcccgtaaccgaacgctccgaaccccccgcatgttttggcagccgtcccggcggccgcagtaagcgctcgccgaatatcctgatgttcgaagaaatcggtaagaaacccggcgataaaagaatcacccgcccccaatgtatctattatatcagctcttaccaccggctgatgatagacgcgttccccatccgataacaccgcgccatgttctccccttgtcagacaaacgattttcgctccgaaaccgcgggctttttcggcaagccgcacacattcactttcactcaaatcactcccggaaaaaaacgcatacgtcacatacggacagaccgcttctaaataggcttcgtcacgttttacagagaaatcaaaggaaatcggcacatggccgctcagcatcggaaggtcacgttctatcctgctgtatacgctcgtatgcagcagatcatgtccggcgataaatgagatgtcattctcctgaaaagcgagcgtcagacgcgattgcacgccgcctttatttgatccggcaaatatcctgtcccctctttcatcaagcgtgacgaccgccatcccgttttctccgtatgcccggcggatcagatcggcattcaccttctccagtttcagcacattcaatacgtgatccgccgcttcatcactgccgagaatcccgatataagaagtttcgtggcctaagcgccgggcaagcacggctacatttaacgcatttccgcccgggtaaaacgtctcctgatcctgataataatctactacattatctccggccgctatcagtttcatcttttcatcccccttatcctttcacgcttcccgctgcaatgccgcggataaaatatctctgcattaataaaaacagcgcgataataggagcagcagaaatcgtcagcccggccagcagcacgccccaatccgtctgcagcgcatctctgaactgcatcagcccggccggaatcgtccgtaaattttcatcatcgataaaaataatcgcaaacataaactcattccatgtatggtaagccgtcaaaatgcctgatgtcaccagaatcggcacgctcataggtaagaatattctgaaaaatattccgaaacttgtacatccatccagataggccgcttcctcaagctctttggaaatcgacaaaaaataggaacggatcagaatcacggtaaacggaatacgataggctgcgtacggaagaatcaatgcccaatacgtattgtacagtcccaatgactggataatggagtacagcggcacaagactgacctgcggcgtcagcatcaagccgccaagacaaatgatcagcacaaacccttttcctttaaattgaaaacgggccagcccgtatgccgcccaggcactcacaaatacggtgatgagacaagtcagcacggtcacaatgacgctgttcataaaataagcggaaatcccttggttccatgcggatacgaagttttcgggatgccagacagagggcagcgaccagctgtgctcaaaaatctcatccgagcttttaaaggcgctgaccgccatccataacagcggataagcaacggcaatgaggtagataaagagaaacagccacacagacgtttccccgacataccattttctcggttttccgcctgttctgacggcctgacgggcatgacgcaagtccgtcttttcaggaagcatcggcctactcctcctttccggtcttaaagaatttcatctgaataagcgacagagcaagcgtcagcaaaagcaccaccgtcgcgatcgcagaagcgtagcccatcatatcctttgtaaaagcgctcttatacaaaaatgtgctcagcacttctgaagcattgcccggccctccgccggtcagaatatacggttcattaaatacggtaaatgcgccggtcagcgtcatcaccacggcaacaaacgacatttctttcgtctgcggcaccgtaatgtgaaaaaactgctggatttttccggctccgtccagctgcgccgattcatataattcagcgggaatgctctgaatcgagacaatgtacagcatggcgatgtaaccgacagactgccattgagacacaaaaatgacagacagcatagcggtgttttcatcgcccagccacgcccgggtcagttcatcaagtccgacggcttccagcagctgattcaaaagcccgatttccgggttataaataaaatcaaacaacagcgcaatgacggtcatggaaatgacgaccggaagaaaaaataccgtacggaaaaacggcgaccattttcttaccaatctgtcttccagcacggccgccagaattaacccgccgccaacctggcaaatcagcgatatgaccgcatacagcacattgttgcggagtgctgtaaaaaacacgggatcgtggaacaggtcaatataatttttcaaaccgataaacgtcttttcgggttgaaatgagctccattcaaacagactgaaaaacacattctcaataatcggaatgtaaacgaacagcagaaaaaccagcgcgggcgcgagaaacagatacggaatgaaacgctttcggctgaccaaagaaatcctcatctcctttctccaaagaaatctgttctattcagatgacgctttgacctgacgcgccgctttctgcacggaattcatcacctcgcgcggtgtcattgtgccgccgagcatctgctgaacgcctgccgcatacacatcggcgatttcaacgtcaacatccatatcaaaccacggcaccattgtttcggcgcggacgatatcctgcacggcttcgcgctggatcggggtggaattgttttctgtcgccgttccctgaaccgcgctgtatttaccgacgtcttttatcagcttctctcccatttttttcgaggttaaaaactgaagaaattccatggcttctttcgggtgcttcgtttttgaggaaatcataaatccttcgggagatccggtcagtgcacggggagatcccttttcgccgctgattttcgggaaaggaaacaagcccagattgaccggttcgacgagcttaatttctgccgtttccgcataaatcatcgccgctttgccgctcgtaaactgctggcgcacgtattcgtgatcaacggagttcacgtgctttgtaaagtacggcagaagttcctgaagcttttcaagcgctttgacatagccttcgtccgtaaactccccggtttccgggctgtaatccttcgcccgcgttttttcatccaccatacgctggttcagcgtcccgatataatgagaaatggtccaaggcgcttttgtgccgaaactgatcggaatatatccgttctctttcaatttctcacagactgtgatcagttcatcccatgtcgccgggggcttcaaatgtaatgtattaaaaatgtctttattataaaagaatgatttagcgtccatttgccacggaacaccgtactgttttccgtcatgcgtaaagggtttgatttgtgactgcacaagctgtgaggaccaatctttatcctgctgatagtaagacgacagatcgagggctttatctcctttgatgaatttataagcaaaccggtcgctccatgaaaagaaaatatcaggggggctcgttgttccgagcatgactttcaccttgtctttataagaatcgtttaagaccgcttccgtttggatatgaatatccggatgagcggcttcaaaatctttgaccgcttcttcaaaatagcttttttccggctccttcggccacctgtgaaaaaacttcagggtcacttttccgtcagaggaactgctttggcttgaacaggcggcggctgacagacatacagctaacagaacgaacaggcagatgagctttttcagatgcttttcctcctttgtcaccggactataacgttatatatcattatagtccggtgaaatataatgcgcgttcttaatattcgactttccacatgtaacgccgctggcttaacggatggttccttgcttccgccagcgcatccgcatagcttctgagcacccggtttaatacgagaggagccaggtagccttttacagaatcgtcaattccggaaaaatcatatgctgccgcatcaagcacagtcagttttttgccgtatctttttgagaaggaaagcgcccgctcttcaaggggtcttgtttcgtctaagccgagcaggataataaatggaacagattcatcaatgatttcgaacggtccgtgaaaatattctccggcatgaatggcgtgagaatgaatccattgcatttccatgagaatgcagatgctgtaggagtaagcgacgccgtagttcgcaccgcttgccatcgtgtaaatgatatcttctttttcgtgggctttcgcgaatgcctttgcgtgatccgcttcttgtttaagcgctttgtcatatacggtctggagtttattgagtccgtcgatcgcctgctcaaacgcgggatggttttccagcacgtgtaaagcgccgaacacgatttgatacagaaccccgtaattcgtatttatcgcctgtgcgttctcaccccagtcatacaccgcgacatattcggcttctttcgctaacggcgaatcaggctcaaaggtcattgcaatcgtaagcgcgcctttttttctggcgaaaccggcggctttcaccgtttccggcgtattgcctgactgagaacataaaatcaccagagagttctctccgagctgaatgggattgcgctgaataaattcatttgaactgtagagatcagagctgatggctttcgcctctctgtcaaacacgtacttgctcggatacataatggctgaagaacccccgcaagcgacgaaaaagacgtggtcaatcgtttttcctttcagatcatccaagaaagcctgaaccttgtgattcacttgtgcggcagtttgactcaaatccttcactcctcagtgttttattatataatgttatataacattatataacgttatattaatcgcaacaaaggtgcgttgtcaatcatattttctgaaatttctaaaatatagaataaacccgtctaatttcccgccctttcttgacctgacccttagagacacgtttagaatgaaaagcagggagtgattcagaatgaatataaaagaagccgccaggcagacgggtctcacgaaaaaagccatcaaatattatgagcaggaaggtttaatcaccgtcagcaaaaaccctgataacggataccgtgagtattccgctcagaacgtgaatacgctgaaaatgattgccgccctccgaatgctggcactgtctgtaagcgatattaaagcgttcctcttagagggcagcagtctgcatgatatactgcgccagcagcatcaaaagctcagccggcagattgaagagcttgagcaggaacggaaactgactgaaatgctgatcaagcgcgtggaagatgcggaaaatgtcgattcaattctgcatgatatcggcgaggtcaaaatagatgaaccgaagtatatgggacttcagctgaaaaaactgttcccgggagatttcggagaatttatcgccgcgctgtttgaaccgttcctcgacttttctattgatacagatgagaaaaaaacgatatgggcaaagcttattaaagtattggatgatatggaagaagttccggctgcacacccgatgatgcagctggtcggtaaggaggacccggctcagctccaacagcacaaagtccagcatgaccaatttatcgagcggattttggagagagaccccgccacttgggacactcataaaaacatcatcattcagcttgtgaaaagagtggagacagatgaagagtacagagaaagcctgatcaagatcggagaatccgcttctgatctgcccgcgctgaaggaaggatcgcctttcagcaatctacttcaaaagctcagcccgaaatatgacacgtatgtgcgacttcagcttgaactgaaaaaagaagccgacgaggaactcggctttgattcagaagcatatttaaaacagatgcttcaatcaaaaaaacgctaaggctcgtctccttagcgttttctttcttcatcctcagtgctgtgcgttaatgcggtcaacgacattagcgatgagctgctcttttcctaaatcggaatcttcgtcaacgcttgctactgtcaaaatgatggccgctaccgcaagagcgatcgtctcaatggcggccgccgcgtttaaaaatacccatacagcacacagccatcaaataaatactgaaaaatgaactttttcacactaaaatactattataggtaaaaaagggagtgttcatatgtttttgatgaatgataaggtgctgtggggagctgtggttctcgcctttattctgtcgattgtgttttatccgtttcttcctgctgatatggccattcactatgacgtgtcgaaccgtccgaatacatcaatcaataaaacggccggcgtcctgatttttcctgtgctcatgatgatctgcatgttattcagaaaaaaggtcgttcagctgttcctcgtcgtttactgtctgctgatcgtgcatattgcagtgatgtggctggcactgtaaacataaagaaaaccggagcccttaagctccggtttttcttatttataaaatactttctcaatgttgtatttcgactgaagggtattgatcgcgtacgtttcgtaaatctccctttccatcggatcattgacgacacatacttcaattttatacacttcgtccctgtgatgtttaacaggcgacacattgtcttcaaaatgctttttgattctttgtcttaatttacgggctttcccgacaaacagcagttcatcatgaatgttataaaacataaagatgccgcctttgtctctcggaatgcggtgaaaatcaatgaaaccgtaaatcgctttaatcgccggttcattttccgacggtgactgctgccgttccgtaatcgttacatcaggagcaggaaggtttatttttatcaaaatgggtcacgtcctcttattcattaaagctccatcctatcataagaatgcgccaaaagctattttttattcaagcgccccggccggatcataaaggctcaaatcaatttccgtctgctggccgagtgcgagtttcgccagttccgcccccagatacggcccgctcgtcagccctgaggcgcccagcccgttggcaacgaggagtccgctgatattcggcactttgccgatgacgggaagaaaaccgggagtaaacggcctgaaaccgactcttgtctctatcacagtactgtctgaaagccccggcgccacagttaatgctttgtcaaaaatctcgcggaggccgccggccgtcacccgcaaatccatgccggtatcgttttcatgagtcgcgcccgctatgattctgccgctgtcaaaggcgagaatgtattgatcgtttgggggcatgacgacgggccagccgcccgtatcctctccctgaagctctaaatgaacgatctgtgccttttggtatgatactgaaaaacggatgccgagcggttcaagcagctctctcgcccaagcgccggccgttacgagaacctggccggcagtaagcgtgcgttctgcggttttcacaccgataacggcaccgtcctctgtcaatattgacgcttcttcattgtaaacagccgcgccgtgattaacggccgcgtttaacagcgccttacgaagcgccctcccgttcacccgggccgcgccgctgacatgaaccgccccgtattcctccgacagcgcggggaacagcgccttcgtttctgccggagtcagtctcgtaatgtcaccgatttcaggagcgtcctctcttcttttataagctctttcctccatttggctgagctttttttcatccgtatggagactgacggcaccgaccttttgatagccggtgtccgtttctccgtcagcttcaagctgctgtatcaattggttataatagcgggctccgccttttgcgatcgcataccatgcctggttgcggcgctgcgacagccacgggcagacgatccctgcagcggcgtcagtcgcctgccccgggtgtttcctgtcaaagaccgttacatccgcaccggcctttgcgagatgataagccgcggacgcaccgagaatgccggctccgataatcatataagacttcatgtgtaacaccttttctatctgttttgtcttatttattttaacaaatagagcgcccggttcctaccggagtcctgacggcaatgataagtttcgaaaacggaaacgtataataaaaggaatacgttcttgtctgaaagccgttttcctcaagaattgctctgtattgtgatgtattttttatatctgacacggccaatgtgccgccaggcttcagcaccctcaccatttccgtgatcgcccgttccctctcttttctgcctgaaatgttgtgtgctgaattgaaagctttcccgagcgggatggtaacggaaatcaatacgtatgagaatatttggatagttcctgtgaacttgtgcttctcatcgcagattgctcgtatgtaacgttatattgcaaagatccggacatgctcgaagccctttttcagcaggctgtacaatgcgggtttcaccgcgttgactatgttacagataagaatgatgcgagaacgggattgtctgtctggtgaaggtggtgcgttctttttatgaagcgctggatagggcttaggattcaaaatattgacaaattcgtgtgttttcaacaaaaaaatcaccccctcatgtatactgagtgcgtaacttacatatgaaaggggtatggcaatgaaaatcaatttgaagaaaaaagcaggtttttggaagaagacggcggtttcatctcttattttcaccatgttttttaccctgatgatgagcggtacggtttttgcggccgggctgaataaggatcagaagcgccgtgcggaacagctgaccagcatttttgaaaacggaaagacggaaatccaatacggatatgttgaagcgttggatgacggaagaggttacacttgcgggcgggccggctttacgacggctaccggagatgcgctggaagtagtcgaagtatatacgaaagcggtgccgaataacaaattgaaaaagtatttgcctgaattgcgtcgtcttgcgaaggacgaaagcgatgacatcagcaatctgaaaggattcgcttctgcctggcgctcacttggcaatgataaagccttccgcgctgcccaggataaggtaaacgacagcttgtattatcagccggcgatgaaacgttcagaaaatgccggactgaaaacggccttggccaaagcggtgatgtacgatacggtgattcagcatggtgacggtgatgatccagactccttttatgccctgattaaacgcacgaacaaaaaaatgggcgggtcaccgaaagacggaacggacgagaagaaatggctcaataaattcttggatgtacgctatgacgatctgatgaatccggcagatgaggacacccaggatgaatggagagaatcggttgcccgtgtcgacgttttccgcgatattgtcaaagagaagaactacaatttaaacgggccgattcatgtccggtcaagcgaatacggaaatttcactattcaataaacaaaaaaaccccgccatatggcggggttttactattaaccgatggagccttccatttcgaacttgatcaaacggttcatttcaactgcgtattccatcggaagttcttttgtgaatggctcgatgaagcccataacgatcatttctgttgcttcttcttcagaaataccgcggctcatcaagtagaaaagctgttcttcagaaacttttgatactttcgcttcgtgctccaatgaaatgttgtcgttcaggatttcattgtaagggattgtatcagaagttgatttattatccataatgagcgtatcacactcgatgtttgaacgggcgccgtccgctttccgtccgaagtggacgataccgcggtatgttacttttccgccctgtttcgaaatcgattttgatacgattgtggatgacgtattcggtgcaaggtgaatcattttcgcacctgcgtcctgatgctgtcctttgcccgcaagagcgatagagagcgtcatgccgcgcgcgccttcacctttcagaatgacagccggatatttcatcgttaatttagaaccgatgtttccgtcaacccattccatcgtcgcgttttcttcacaaaccgtacgtttcgttactaagttgtaaacgttgttcgcccagttttgaattgttgtataacggcagtagccgccttttttgacgatgatttcaacaaccgcgctgtgaagcgagtttgttgtgtacacaggagccgtacagccctctacgtaatgaacgcttgcttcttcgtcaacgatgatcagcgtacgttcgaactgacccatgttttcagagttgatgcggaagtaagcttgaagcggtgtttcaaccttcacgcctttaggcacgtagatgaaagatccgccggaccaaacagctgagttcagcgccgcaaacttgttatcagtcggcggaatgactttcgcccagtgctcgcggaaaatgtcttcattttctttcagcgcgctgtctgtgtctttgaagacaatgccttgcgcttcaagatcttctttcatattgtggtacacaacttcggattcgtactgtgcagaaacaccggcaaggtatttttgctcagcttcaggaataccgagtttgtcaaatgtctgtttaatttcctcaggcacttcatcccaagaacgctctgaacgctcagacggctttacgtaatacgtaatttcgtcaaagtttaaagagtttaaatccccgccccactgcggcatcggcatgttgtagaaatgctcaagagatttcaggcggaaatcaagcatccattgaggctcttctttcatgcgtgaaatttcttctacgatttcttttgtcaatccgcgctctgaacggaaaatggaaacgtccttatcgtgaaaaccgtacttgtattcaccaatttcaggcatttttttagccatccattttcactccaatcttttaattgccgcctttttcgccagcgactcctttttcaagtgctttccatgaaagggtggcacatttaatccgggccgggaatttcgaaacgccttgaagggcttcaatatccccgagatctattgagtcgtcatactctttcccttgcatcatgtctgagaaaatcttagacatggaaagggcggtatcaatatcttttcctttaatggcctgcgtcatcatggaagctgaagccatggagatggaacagccttccccttcaaacttcgcttcctgaacggtatcgccgtcaagcttcattgtcagtctgatccggtcgccgcaagtcgggttgttcatatcgacgacgatgctgtcatccaaaacccctttgttgcgcggatttttgtaatgatccatgatcacttgtctgtataatgtatctaaatttgcattaaaagacatttgtaaagtactcctttgtcttttggagggcttccgcgagcttatcgatctcttcctctgtattatacagataaaaactcgctctcgcagtagcagatacatccagccatttcatgagcggctgggcgcaatgatggccggctctgaccgcaatgccctcagcatcgaggacagtcgcgacatcatgagggtgaacctcatcaagattaaatgtcacaagtcccgcccgctctttcggaccgtataccgtcacgccgtccagctgctcgaaacggtcaagcgcataggctgcaagcttatgctcatgccgggaaatctcgtcgagtccgatctcttcaagaaaatcaatcgcggctcccaatccgatcgcgcctgcgataatcggcgtgcctgcttcaaatttccacggaagctctttccaagttgattcataaagccctacaaagtcgatcatttcgccgccaaattcggccggttccatattctcaagcagttctttcttgccgtacagcacgccgattcccgtcgggccgcacattttatgggaagaaagcgcgaagaagtcgcaatccaggtcctgaacgtcaattttcatgtgcggtgtgctctgcgccccgtccaccacgatgacagcgccattgtcatgagcgattttggcgatctctttaatcgggttaatcgtgccgagcacgtttgacacatgagcgactgccacgatcttcgtatggcttgtgacagtctgccggacgtcgtccagcgaaagcgtgccgtcttcctgcatcgggatatattttaaagtcgcgccggttgcttttactgcctgctgccacggaatgatattcgcatgatgctccatttgggtgatgaccacttcatcaccgggttttaagctggcgcgggcatagctcagcgccaccatattcagtgaagttgtcgtgccttttgtgaaaatgacctcagccattgacttcgcattgataaacttacggactttttcacgcgcaccttcatagccgtctgtcgctctcgtgccaagagtatgaacgcctctgtggacattggaattgtatttgctgtaatactgatccactgcttcaatgacagcacgcggcttctgggaagtcgccgcgctgtcaaggtacacgaggtcatgtccgttcacttgctgatgaaggatcgggaactgttcacgaatatcggtgatattcattattttactttcctttcgatgacggagacgagctgtttcttaactccttcaatcggaagctcttttaccaccggagcaaggaatccgtaaatgactaagcgctccgcttcttctttcggaattccgcggctcattaagtagtaaagctggatcggatccacacggccgacagatgccgcatgtcctgcagttacatcgtcttcatcaattaagagaatcgggtttgcatctccgcgtgctttttcactcagcatcaggacgcgggattcctgttcagcgtttgctttagacgcgccgtgctcgattttgccgattccgttaaagatggaagatgcggcatctttcatgactccgtgcttcaggatatagccttcagaagccttaccgaagtggatgatctgcgtcgtaaagttttccgtctgttctcctcttccgacaactacggttttcgtatcgccgtatgtgccgtctccgtagaggtttgtcgtgttttcagaaatcgtgtcgccgtcgttcatcagtccgagcgcccactcgattttgctgtctcgtccgcgcgcggctccgcggcggttgacgtatgttgtgacacctgctgacaggttgtcaacggcgccgtacgtcacgctggcattatcacctgtgaccacttcactgataatgttgaataccgcttctttcggattcaccgtgctgatgtagttctcaacgtaagtgacggagctgtggtcttcagcgacgatcagcacgtggttgaacaatgccgtgtcattgctttcatgaacgtaaacggcctgaacaggcgtctccacctgaacgtttttaggaacataaaggaatgccccgccgttcattaatgccgcatgaagcgcagtcagtttatgctcgtcgacctttacgccgtctttcatgaagtatttctcaacgaggtcgctgtgctcacgggcagccgttaagatgtccgtgaaaataacgcctttgtctttcagttcttttgaaagagaaaggaaagcaggcgtttgatcacgctgcacatataacgttttatcttcgttttcgatatcgatcagcgcttttgcttcatcagctaaatcttctaaagaagcaagcggcgcgttttctactgtatgcttgttgaactttgtaaagttccaatttgtgatttttgttttatcaggcttaggcagcggcagatcttcagctttttcaagagcctgtaagcgcaggtttttcagccaggcaggttcttgatgcttttcggaaaagcctttgacatattcctgatctacggatagtttcgtttccaatgtcatgattatccccctaacgcttacgcttcttggcctacagtttcgtcttcaatgcctagttcctgtttaatccagtcataaccttccgcttcaaggcgctgtgcaagctccgcgccgccggatttcactacgcgtccttgcatcataacgtgaacgacatcaggcgtgatgtagttcagaaggcgctggtagtgagtgatcattaagcagccgaagttttcgctgcgcattttgttgattcctttagaaacgactttaagcgcatcgatatcaagacctgaatcgatctcgtcaagaatggcgattttcggctcgatcatcataagctgaaggatttcgttgcgttttttctccccgcctgagaaaccttcgttcaggtaacgctgcgccatttcagggtccatttcaaggaactccatgttttcgtccattttgcggatgaatttcataagagaaatttcatcgccttcttcacggcgtgcgttaatcgcagagcgaaggaaatcggcatttgtcacaccgctgatttcgcttgggtactgcatcgcaaggaaaagacccgcctgagcgcgctcgtccacttccatttccagtacatctttgccgtcaagcgtgatgcttccttttgtaacttcgtatttcgggtgtcccataatcgctgctgagagcgtggatttaccggtaccgttcggccccatgacagcgtggaattcgccgccttttatttcaaggtttacaccttttaagatctcttttccttcgatttcaacgtgaagatccttgatcgttaatgttgaagcagccatatctatacctccaaaatatataatcattattctcaatttattctcattctaattttataacaaatgaaaagtaaatacaactttttatattacccggaacattcctaaagtttatcaaagatcaaggcgtaattaaagctgtttgaaacagaaaaagggcggaaatccacccttttttactgaccgattttctcattaagctgcgctgcgaggaacttgcttttttgatattcaagctccctctgccgttcgacttccatcctttttgaaagacgccgtccgtattcctcgtagccgatgccgtgtgacttctgcatcgctttttccatttcaggcgtatagtcaaggtccagtctctcgtggctggtgcagataatgaatcaatcccttcatatatttgtttctattgtaacaatgatccgctgctccggccaaagagggtgtgcccctgaatcctttcgaatgtgccggaaaccggcgctcgctttatctgaaaaacggtattcacacgattgctcattctaatgcgtcgtatgtccgaattcctgaatacactgctgcacgagggtcactccctgactgagagccgcgccgcccccgaatgccgccgcgacgctgatgacctcaaggatgttttcttctgtggccccttggtcaaggcagcccttcgtatgataaatcatgcaaaattcatcttgagcgctgatgctgatgcccagagcgattaattgtttctctttttcagttaatgaatccgctgagaaacactgctcagtaaattcattaaacttccgccccatcatgggcattttttgctcgaatatgcctaaaccttctttatattgtttcaatgcgtcatgcacgctttttccgttatcctggtattgagccactgccattccctccaatcgttaaccttcctttttattatggacagttctccgattaatacccgaaaaaaaccccggatgattcatccggggttttcgctttattcagatacgggaagcacggctccgtcgtattttttctcaataaagtctttgattttcttagagtgaaggacttccataagcgctttgattttctctgatttttcgtcacctttgcgtacggcgatgatgtttgcgtacgggttgtttttcgttgattccacttgaatcgcatcttttaacggattcagtttgttttgaatcgcatagttgacgttaatgaagactgcatcgccttcttcttcattatatgctttcgccgttaattcaggggcgatttttttgaatgtcaggtttttcgggtttttcgtaatgtttttcgtagtcgcttcaatcgtttttaccttcggatcaagtgtgatcagtccggctttttcaagcatcgccagcatacggccttgttcagcgacattgttagtcatgatgatggtcgcgcctttaggcaggtctttcagtgatttgtattttttcgtgtaaactccgaacggctcaaggtgaacggctccggcattcacgagtttgtaatctttattttctttcatttcctgttcaaggtaaggaacgtgctggaagtagttcgcatccacttcattatcagctaacgctttgttgtacattttgtaatcgttcagcacttttacttttaatgtgtagcctttttccttcaagagcggttccgcttcttttaagatttcagcatgcggtgtttttgtcgcggcgacaacgatttcctttttattcgagccgtttgatccgcaggcggctaaaactcccgcgaacacaagcagcagcgcacttaatacaatctttttcaatgtaaatcctcccttatcttttgtctattatatttgtaattacatcaccgataatctgaatgataaagacgatgatgagtataaatactgtcgctacaaacgttacatccgtattattggactggtagccttctacatatgcaaggtttccgagtccgcctgaaccgatggcgccggcaatggcggtagatccgatcagggcgatggccgtcacggtgatgcctgaaattaacgcaggcattgattcaggaatcagcactttgaagataatcgtcgatgtctttgctcccattgatctggcagcttcgatgactcctttatcgacttcccggagcgcaatttccgcaagacgggcgtaaaacggcgcggagccgataatcagcgccggcaatgcggcattcggtcctaaaatcgatccgaccagaatcttagtaaagccgagaagcagaataattaaaataagaaacggaatagacctgaaaatattaacgaccgccgcaatcacggtgttaatgattttattttcccataagcttcccttgcccgttaaaaagagcagaagaccgagaatcgctccgatgataaatgaaaaaactaaagcgatgaccgtcatataaagggtctcatatgtggccgtccacagctcggttatatcaacgttcgggaaccatttttcaaacatttgtgatcacctctgcttctacctgtttgtctttgatgaaccggatcacgttttctacttctttttcctgaccgtcaatatgaatgaataatgaaccgtaagctccgtccttcgtctgtgaaattttcccctgcagaatattgacgtccacatcaaagtttcggatcatttccgtaatgaggggctgctcggcggcctgcccgacaaatgaaagctgaatcgttttccctgtcgctgtttcctgcagaaaatgctggatggtttctttcgtctcctccggttctgtcacctgctgaacgaaacgcttggtcatcggttcgcgcgggtttctgaaaacttggagtacttcgccttcttcaacgactttcccgttttccatgacggcgactctgttgcagatttttcggatgacgtgcatttcatgggtaatgagcacgatcgtcagaccgagtctgtcatttatatcggataaaagatccaaaattgaatcggtcgtctgcggatcgagcgctgatgtcgcttcatcgcacagaaggactttcggattattggcgagcgcccgggcgatgccgacacgctgcttttgaccgccgctcagctgcgacggataagatttttctttcccctctaatccgaccagtttaatcaattcatcagcgcggcggacccgttcgctttttttcacgccggcgatttccagcgggaacataatgttctcccggacggtgcgcgaccacaaaaggttaaaatgctggaagatcatgctgatttcctggcgcgcttttctcagcccgcggctgcttactttatttaattccgtccccgcgacttccacggttcccgacgtcggcttttcaaggccgttcaggagacggattaaggaacttttaccagctccgctatatcctataattccaaatatttcgccctttttgatatcaagagtgacatcttggacagcattgacatccccatgcttcgctttgtaaatttttgaaacattttgaagatggatcaaagcaatcacccgccttacactattctaagaaatcttccgggtttctccgcaaaagaaaagcctttctgcaaaaatgagcagaaaggcttattgaaaaaggcctttctctcatctttcaaagcagaccgctttgagtgaattggcaccatttcaacattgttgatggttgccgggcttcatagggcacttccctccacctctcttgataagagaaaacatatcgtattttcgtccggaaattcttactgtagaatagcacggcgaatgataaaaagtcaataaaataaatattggaagctattgtcacatagtagattggcagttacggccgtttactgatcgcctgaaaaaatccgtttgtcagccagaggatggcctccagcttcagcagggctctgaatgatcctttcactttgagttttccgctttggataagcttttgcaaagagacatcaccatgcaggagatggatgatttccgtctggtttccgtaaaaggtcaaattagatttctcctttgaagccgacgtttttctcatttctccctgtccgttaattgagaccgttaaggcttctgtttctccttggaatgtaatcagcagcgttgaggcgtttaatagcggtttcaaaaacagatgctgtccgtcattctctgaaacttctattttctccactcgtataacctcccgttttaatggccatacatacactttctctttttaacggacagaaccctttataaaccgcacgacattttcctgtaaatattgtcacatcgggaacgtttgcgatgttttttgtttaatcagctcatataaataggaaacggagcggaaggcgtatcctttctcaacaagctctccgcctttaaacagcaaaaagcacggaacgctttcaatctgataggctttggcgaatgcgggggaataattcacgttgtttttatagaaggcggcaccgggcagcatttcttcgacgacagtaagcattttggacgccagctggcatgtgccgcaaaacggggtgtacaaatacaggagataaacgtcatcctgaatcgattcgagttcattttcttggagttctttcatgattaccacctcaggtcgttctttttcaaaaatacagtgtcagcatcaaagccggctctgatcagcacagatgcgagatgatggcccgggcacgactcgacttgcctgtatgttctgtctatataaatatggcgcgcttcgggaagctcccgtttcagctgttttcttaatttttctccggagtcatctgcgtccgttaaaatatagacgtctctgtcaaacaggcggtccgccaactcttccagttcggtttggccgatcgtcccgtttgtacagacgatttccgcgggttcgatgagcacttccctgactttgattttatcagattttccttctacgataatgaccttttcatctccgttgtacataagcgcgtcacctgccgattgttttagcgtcagattgaaaaagaaggcagtgaaattcaccgccaactgttaacaccagccattctcataatcgcaatcgacatatttcggatcgctgccgtttatgacatcggctgttttataaaatttttgattttcaaatgaaaagccctgtttgagctcgtactggtccatgcctgtcatctcgccgatggcttcattttcatgaaacaaggaaaaccggccgttttgaaagcggcccgtgacgttctccgtcacatcgaccttttgtttatcaaaagccattttagacacctcccgttacagatagagtgtccaaatggcccctttgctatccgatcagtcttcctgtgtcatttcgtcatattgctcagaagtcatgaggttttcgatttcttcagcatcagccggttccacgacgatcatccacgctttttcatacggagactcgtttacgaattcaggactgtcatcaaggtcttcgttcacttccgtcaccgttccgttaatcggtgcgtacagttcggatacggttttgacggattccacgctgccgaatggctcgtccgctttaatttcggcgccgacttccggaagctcgacaaatacgatgtcgccaagttcggcttgcgcgaaatgtgtaatcccgatacgggcttttccgtcctcaactttgacccattcgtgctctttggaataacgcatatctttcggtgtgctcatctaaatccctccatttttttcttataataagaagataccataattctttgaacctggcattacatccaatatttttcgaattggtcttctttaaagccgacagtgactttttcgccgtctgtcgtaatcgggcgtttcaggagcataccgtctgatgccagaagttcgagctgttcatcctctgacatatggtacagtttttcctttaagttcagctcgcggtatttcattccgctcgtgttgaaaaactttttgagctcaagaccgctcttttcatagaggtctttaatttcttctttcgacggagtttcctccgcgatatgtatttcgtttatttccttaccgcggtcttccagccattttttcgcattacggcacgttccgcatttagggtaccagtaaaaatttaacgacatcttcttcaccccttgtaaatgatcgtcgttattttaacacaatcacttgtaaaaacctataacgttgcttcatgaaaaagcgcccctgatgaaggagcgctttcagcatgtgatcagactgtatatttttcttcacggaagacggctgctgccgcttcacgttttttctgaatgaggtttttcggcgtcaggcgcgtcagtttgcgcagcacggaaagcatcatgcggagggaatctccttcctccatggcgatcagtgattctttggcgtgcgcttcaatgttctgaagggcttcctgggcaaagatttccgtatataacagcttctgcgcggctttttcggcaccgtccgccgcaattgctttttccgttctgaggacggcagattccaaagcatacagcgcgctgacaatatcggcaatgttcaccatgatttcctgctcgccttcaatctctttgccgtatttctgcgccgcgagacccgctgtcaagagggcgatctttttcgcctgtctgacaatgtatttttcctgttcaagaggttctgagcccggctcttcaggcatcagcatcatgagttcttcttggagcgcttttgctttttcaaagagcggcagctgaccttttacggcttttttcagaaacgtgctcgttacgatcaggcggttgatttcatttgtgccttcaaaaatcctgttgattcttgagtcgcgataggcgcgctccacttcatattcctgcataaatccgtaaccgccgtgaatttgaaccccttcgtcggcaatgtaatcaagcgtttcagaaccgcacattttgttgagcgagcattcaatcgcgtactcggcgatggacttcgcgacttcgcgtccgtctttttgctcctcttccgtcagtctgctcatattatcttcgaataagcccactgttctgtatacagagctctccatggcgtaaagccgcgctgacatcgtcgcaagcttttcctgagtgagcgtgaagcttgagatcggcgttttaaattgccggcgctggtttgcataagcggcagacagctcaatcacccgttttgaagcgccgattgtgccgacggcaagcttgtagcgcccgatattcaggatattaaaggcgatgacatggccttttccgatttcgccgagaagattttctttcgggacttccgcctgatctaaaatcagcgttcttgtcgatgaacccttaatccccatttttttctcttccggtcccgttgatacgcccggatagttcttttctacgataaatgcggaaaacttatctccgtccactttagcgtagacgacaaagacatctgcaaaggcggagtttgtaatccattgcttttctccgttaagaatatagtgtgtgcccgcttcattcaaaacagccgtcgttttcgcgccgagggcatctgaacctgaaccgggctcagttaaggcgtatgccgcgattctttgtcctgaagccaagtccggcaaataggtttttttctgttcttccgttccgaagaacacgatcggcaatgaaccgatcccgacgtgagcgccgtaagatagcgaaaagctgccggcacgtgaaaacttttccgtaatgaaggctgaactgattttatccaggccgattccgccgtactcttcaggcacgtctgctccgaggaggccgagatctccggcttttctcagcagtctgaccgaatgctcaaactgatggttttcaatttcatcgatataaggaagcacatcgtttacgacatagtcttctgtcgttttgccgatcattttatgttcgtctgtaaagtcctccggagtgaatatttgatcatatcccgtctcttcaatcagaaagctgccgccttttttgacgttgaccgtttcctgtttcatgttcatttccccctttttttaaatgagttcaaatacgccggcagcgcccatgccgcctccgatgcacatcgtcacaacgccgaattgctcgtttctccgtttcatttcatgaatgagtgacagggtcagcttcgtccccgtgcagccgagcggatgtccgagcgcgatggcgcctccgttgacgttcaccttttcttcatctatcccgagcgatctgatcacttgaatggcctgtgaagcaaaggcctcattcaattcaaaaagcccgatatcctgtaattcgagtccggcaagcttgagcgcccgcggaatggcttcaatcggaccgatccccattacttcaggcggaacgccgcctacggcaaaggaacggaatttgacaagcggggccaatccaagcgacgatgctttttcgcgatccatcagcatgacagccgccgcgccgtcacttgtttgtgaagagttcccggccgtcacggttcccgtttttgaaaaagccgggcggagcttcgccaagacgtcagccgacgtgccgggacgaacgccttcatcctgagaaaaggtaaattgttttttccgcggcttatggtcatcaccgacttctgtcagcgatacttcaaccggcacgatttcgtcattgaatttcccttccttaagggcttttgcggcattctgatggctgcggactgcaaatgcatcctggtcttctctggatactccgtacgtttcggcgacctgctccgccgtatgccccatgctcatgtaatactcaggcgcatgctccgccaaagcgatattcggccgtgtcacatgccccatcatcggaacttgcgacatggattccgcaccgcccgcaatgacggtatcacccgcgccgatcataattttttcagcaccgtaagcgatggattggagcccggaagagcagtagcggttcaccgtaatggccggcaccgtatgaggaagccccgccagcgcaccgatattccgagccatatttaatccttgttcggcttcaggtgttgcacatccgataattaagtcatcgatatttccttcatagccgcctgcccgtttcagcgtttcttttacacaaagcgcgcctaaatcatcaggacgaacggctgcaagcgatccttttttcgctttaccgaccggggttctcgcaccggccacaatgactgcttctctcataaacaccctcctagttccgtaaaggtttgcctttgacgagcatatgctgcattctcgcttgagatttcgcctcgccagcgaggcttaaaaaggcttctctttcaatctcgagtaaatattcttctgaaacctccgtgccgaacgggactcttccgccggcaatgacatgggccagcttcttcgcaatcttcatatcgtgatcggataaataacccgaccgtctcatttggtctgctccgagcagtaatgccgcacagccggtttctccggtgactttcacttttttgcgggcaggcggacggtatccgctgtcatataaggaagcagccagctgtttcgcatcgtgcagcaggtgatcctgattcatgctgatacggtctgccgcggacaaaatcttcatgtcacgggcttcgtgtgccgaaccggacaccttggcaagcgcgattgtttcgaaggttttaatcgctgcgtccatgagttcacttccgccgtccagataattcatgtacagctctttgtttcctccgccgcccggaataagaccgacgccggtttcaacgagacccatatacgattcgctcgccgcctgaacgcgtgccgccgggagacagacttccgtgccgccgccgagtgtcatcccgaatggcgccgctacaaccggtttagcgctgtatttgatgttcagcatcgtctgctgaaaacggcggatgacaaaatcgacttccatgaagttatcatcctgggcttccattaaaatcatcgcaaggtttgctcccgcgcagaaatgtctgccttggtttccgatgacaagacctttataattccgctccgtttcctcaagcgcattgtcaatcatctgaataatgtctaagccgatcgcgttgcttttcgtatgaaattccagcagcgcgacatcatcgccgagatcaaccagacttgcgccgctgtttttagtgataacgccttttgtttcttttaacgtctgcaggctgatccgtttcggattttctttcacagccctgtattggccgtctgaataataaaattgtgttccgttttccttcatataaaatgtttcatgaccctgatcaagcatttctttcacccagccggggagtgctgcgccttcttcttcgagccgctccgctgattttctgacgccgatggcatcccacatctcaaacggtccgagctcccatccgaagccccatttcatggcgtcatcaattgcttttatatcatcagcgatctcacctaaaagccgggctgagtataagagtgtttgcgatgtgatattccaaagcaggcgtccggcgcggtcatcggaatatacaagcgctttcattttgcctttggcaccctttgcctgtttggcggcttctaaagcgggcgtcttcattttcgagcgctcaccgtatgtcatggtcagcggatcgagttcatatattgttttaccttcttttttgtaaaaaccttggcctgatttgctgcccagccaattgtttttcagcatgtcattcataaattcaggaagcttaaacatgtctttttcagcgccgtcggctttatcatatacgttttttgccacatgagcgaaagtatcaagccccacaacgtcaagggttctgaaggtcgcgcttttcggtctgccgatcaaaggtccggtcaccgtgtccacctcgccgatgcggcagccggaagaaagcatttctcttaccgtgaccagcaggccgtacgtaccgatgcggttggcgataaagtttggcgtgtcttttgcgatgacgacacctttcccaagcgtgttttctgcaaatgaagtcataaactccagcacgtcaggatctgtttcctgaatcggaatgatttccagaagcttcaagtagcgggccggattaaagaaatgggttcctaagaaatgagccttaaaatcggcagatcggccttccgccatttttgtgacggagataccggacgtattgctcgacacgatgcttcccggtttccggtattcatcaacgagtgagaaaatctgtttttttacgtcaaggttttcgacgacgacttcaataatccaatcagcatccttcaattgagctgcgtcatcttccaaattccccgccgttatatagtcgagattggcagccgaagtcagcggcgccggtttttgcttcagcagcttttgcatggccgatcggctcagtctgctgcggacctccgggctttctaatgtcagcccttttttcatctcatcctttgtcagctcgtttggcacaatatcaagcagcaggacgggaattccgatgttagccaagtgcgcggcaattccggaccccatgacgcctgatccgagaacggctgctttctttataaacttgtgcatgagtcatcccccttgaactttgaatgaatagtcattcattttttcggcaaaaaaaatgaaacccttttcttctttcatcttaaaagattttcaggatgacttcaatagcaaatatggaatttttttaaatttttcggcttccgcatgttccatggcgcgggcgggaaacttaaacccggaggtgaagggaatggtgcgagggagaaaagatccgtcttctgccgcagtgagcgcggccagcatgaaaggaaatgcgggaccgaagcaaaaatacggcggcggcaaacggacgagccaaaatcagcaatataaaaaagacaacatggaataacatactgcggctgctttttggagcagccgttattttttgaagattcctttcagcacaaacgccgcatttgccgggcgctcggcaattcttctcatcaggtacccgtaccaatcggttccgtacgggacatacaccctcatcctgtatccttcttcggcaagctccttctggcgctccgttctgatgccgtacagcatttggaattcaaactgctcccggggaatctgatgctcgctgatgagtgttttcgtatacgaaataatatcgtcatcatgtgtcgccaccgccgtttcatagccgctcaaaagctgcagcttaatcagctgctgaaaatgaagatcggttgcttttttatcagggaacgcaacggccgccgattctttataagcgccttttacaagcctgagccgcggcttatatggcatcagaccgctgatgtcttcagctgcgcggtataaataagcctgaatgacggtgccgagcatcggaaaatccggcttgcaccgcttatacagctcaagcgtacggccgcatcttgaatagtcctccatatcaatcgttacaggcacgccgcgttcttttgcctccgtcaatatgtctctgacatgctgttccgcgagttcctcggaaatatccagaccgatggatgttaatttcagcgacagctcacaatccagttgattctcggcaatcgccctgattgcttttttacattcttccgccgtctttttcgcatccttctctgaacccgcatattcacctagataatcaatcgaagccgacagccctttttggttcagccgctttaccgttttcacagcttccgtgagcgtttcccctgcaacgaaccttcccgcgccgaagcggattccgtaagcctgggcgaattttgtaagcattttatttttcgacaaaaataaacatatgctccgcagcaaggatgaactccctcctttttcttttattcgtgtatgaatttccgatcgcagagaaagctaaaacacaaaagccatgcagattgccaagatatcattcatatatccatacagactctgatgtcaaagcaatgtattatattatcaagatattcaaacggttttaatgagtcacaaaaaggatcaataaaaatcactacttcttcaattgagttttcgagctataattccgcttcttcgttacatttcgcccaaaaaaacttataatttatatttctttatccccttataatttgaaaatattccttaaaagataattgatttataatttacaatggcttatatttaaaattgataattcagtttattgaacgtatctattaagaaggaaaagcagaatttcaaaatgataattctgctgaatttatctttgcctcacaaacatacctccaaagcattattatttctttctaatagctttacgatccttcatctttaaagatggcttctcttccctaacggaatttaaagaagggacctgcctgagttatccattcaccttattttgaagaatcactaagctcgaaacatatgaaaagagggaaccttcaattggattcaacaggaaaatctaaacgtacacttttattaattggacttattatagctatgtttttttctgctctggacggaacaatcgtaggaacggttatgcctaagattgtaggagatctcggcggcctgagcatgatgacttggctgactacggcctacctattaacatctacctccatcgttccgatcgctggaaaacttgcagatctattagggcgccgggcagtatatgtggccgggctgattatattcatgattggctcttcactgtgcggcctggctgataacatgaaagaattaattgtgtttcgaggtttacaaggtcttggcggaggcattatgatgccgatggctatgattgtcattggagatttattcacaggcaaacagcgtgccagatttcaaggcgtatttggcggtatttacgctcttgcttctgtaatcggtccgcaaattgggggatggattgtagattctttcagctggcattgggtattttttatcaatttacccgtgggaatggtagctgtgttctttattgcgatgggattgcaggccagaaaatacacgggtccgattcattttgacttcatcgggatgtttacaatgattacgggtgtagtctgtttgctgcttacactcagtttcggcggaaaagaatttgactggttatcatggcagacattttgtctgttagctttggccactataagtattattagttttgtatttgcagaaaaaaaagctgcagaaccaattctgcctatacatcttctaaaaagcagaacttttatcttcttaaatttaatagggttctttatgagtattgggatgtttgcagcaatcaccttcgtccctttcttcatgcaaggaataatcggcatgagtgcatcagagtccgggacaatcatgatgccgatgatggtcgcaatgattatctccagtattataggcgggcagctggtctttaaaatcggcattaaagcgcagattatcacggggatggcaatcatatcctttgcctattttttattatccacattagaagctgacaccagcaaattaactgcaactacttatgtagctatcatcggcttcggtatgggccttgttatgcccattattactctggcacttcaagagagtttctctaaagaaacgctcggcgtggttacttcgtcaagccaatttttccgctctatcggaggtacgtttggaattacgattctgggagcagtgatgaatgccaagtcaggaaatatattaaccgataaattagttccttttttagacaattttccaaaacaagaaaacgcattagcagctcatctcaaagacttgatcagcagcaatcctcaagtcctgctacagaggctattcagttctggttcattcgaacaatttccgcattctatagcaaagcacatcataccgataatgaagacagcgttaatggactctcttcgcagtgtatttttcgcagggcttatactattaattgccggagtattttctgcttttcttttaccaaaaataaaaataactgaaagaaaagccggcactgatctagacaataaaccggcagctgaagtccaatcctagtgccgctgctgactttcgcatatatcgaactgttaacatgaacagacattatccgaaggttttttcttctgatagtgtctttttttattgtaaatattgatgtctctcctgcaaatcgtggttattttaatttatctgtatgaaatcccgatcgcagagaaagctaaaaagaacagaattgaaggaggcgtttatatgaacaaccaagagcagcacggaaacttgccgcctgccgtcatctcaacgaaagaccatttgtatcttgaggacatgctgaactggaatctgcttgccatgaaaaaagcgcattttatggcggaacactgccagaatcagacgttaaaacaagagcttgatcagatcggccggatgcatgagaagcattatcagcacatattgggccgcttgaaccccggtcaaggcggacagacaacaacaggctatatgcaataggaggacaatacatggaacagcaaaatcaaaaaatcacgaatccgcaaacgcccgtgcccaatacggcgcaaatgaatgacagagacttggtcaatgagctgctgacgacggaaaaatacatcacggcttcatattgcacagccctgcacgagttcagccacgagtctctttatcaagatattcaggcgattttcgatgagtcacaaaaagcgcaaagaagattatacgatgtgatgtttcaaaatggctggtattccattgaagccgccgatacccaaaagcttcagcaatcgtatcagaagttccggcagaccattcagcagcagtctccctaccagcagtaaaatgaaaaaggatttgatgttttcgccaagcatcagtcctttttttatttttgcacaaaaagattgacttatcattaatccttatttatatttaactaatgttaattattttctcaaggaacaagatgaggaggagttatgaaaaacgcggatcaatatgtgtctgacatccagaaatctcttcagacgctgctgcaaaacatacagcctgaaatggtggaaagcatggcaaaacacgaggtgacgcctgcccaattatttgttttagccagcctgaaaaaacacgggagctgcaaagtttccgaaattgcggaacgcatggaggtaaagccgagcgcggttacgctgatggccgaccgcctcgaacaaaaaggacttatcgtccgcaaacataaccagcaggacagacgcgtcatcgacatcagcctcaccaaaaaaggcgaaacaaaattcgaagatgttgtggaaggacggaaagcgatactggcgcgtaacctgtccgttctgactgacgatgaactgattcagtccgtgaacatcatccgcaaagtagcggaagccgccgagaaatacgcggctgatcaaaaagaaaacgaatagaaagaggagctgccgaaacatgagcattgaaaagaaagatccaaaacgcacattattaataacgggcttaatcatcgccatgtttttctcagcccttgacggcaccatcgtaggaacggcgattcctaaaatcgtgggtgacctcgggggattaagcatgatgacgtggctgaccacggcatatcttttaacttcgacgacgatcgttccgattgcggggaaacttgcagatttattggggcgccgcgtcgtctatgtgtcaggtttattgatttttatgggagcttccgcactgtgcggaatggccagcaacatgacggaactgattattttccgcggacttcagggaatcggcggcggtgtcatgatgccgatggccatgatcgtcattggggatttgttcacagggaaacagcgtgccaagttccaagggcttttcggagcgatttacggccttgcttccgttatcggcccgcaaatcgggggctggattgttgactcattaaattggaaatgggttttctatatcaacctgcctgtcggaattttagccgtgatctttatcgcaagaggacttcaaggcagaaaacagactgggccgattaactttgacatcgccggcattttcacaatgattgtcggaatcgtcagcctccttctcgcgctcagcttcggaggaaaagattacgcatggggctcttggcagattctcggtctctttgcgcttgcgcttgccgggattgtcggattcattttcgctgaaatcaaagcaaaagaaccgattctgccgatgtacctgtttaaaaacagaacgtttaccgtactgaatctgatcgggtttttcatgagtatcggcatgttcggcgccgttacgttcgttcctttctttatgcagggaattatcggagtcagcgccaccgcgtcaggcacgattatgacgccgatgatggtatctatgattatcacaagtattatcggaggccagctggtttataagatcggtattaaaccgcaaatcatgatcggcatgctgatcatggccgtcggcttcttcttattaacgaccttacagctggatacaagcaagctcgcggctacgtgctatatggcagtgatcggtctgggaatggggctcgtcatgccgcttctcacactcgctctgcaagaaacgttttcaaaagaagagctgggcgttgtgacttcatcaagccaatttttccggatgatcgggggaacgttcggcattacggtgctcggcgctgtcatgaatgccagatcaggaagccttttaaccgacagactggtgccttacttagactcactcccgaaacaggcaagtgcctttgccgcccagtttaaaggtatgattgacaaaaatcctgaagggctgcttcaatccttgttcagtcaggaatcgattaagcagatcccggccgcattttcttcccatatcgtgccggttttgaaaacgtcactgatggattcgcttcacagcgtgtttttcacaggcctggcctttatcgctgccggattgatcctcacgctgtttgttaaatcaattaagctgacaaacaaaaagacaggcaaacaagaagaaaaggcgaaagccgtttaacaaagaaaaatcccgcggatgccgcgggatttttttatatcatctgggcctctccgtttccgaatgaccagtcttccgcctcattggaaatcgggggtgaaaattatttaataaaccttaaacatttcatagttatctttatagtacgacaaaataaagtcacgaaaatttcttaccgaagaagataacagcttatgtttcatccaagataagccgactggatatgaagcagagtgatcagtcacttttataaaattcagccccaatgttctgcaaaccgaaataggaagcaacgccaccccctgatccagctttataatctcggccagtaaatgagaatccgcctcaaatgcaatatttggggtgaaaccggctttttcacaaagcgaggctgtaaaaccgctatactcttcattattagcaagggtaataaatggttcatcggcgacaagacgtaaagaaatttcggttttacccgtaaatcggtggtttgagggcaaagccagaacaatatcttcatttaccagcatacaactttctatctcttcatcttgaataggatgacctgttattcctaaatcaatgtcccctttttttaaacttgttaggatcccgcttttaactccgatggcttggagaatttttgattgaggggagcggttgatatattcactcatcagtcctgcaaggaatctcggattagaaatagatattctgatggtgtcagacatttgatgttcctccaattgaatttccgtttgtgcattttcaatctcagtaaaaatcctgtttacatgttttaaaagaattttccctgatgaactcagcttaatatttctgccttttctctcaaacaaagctgttcccagttcattctcaagtctttttatagtgagacttaaagaaggctgggcaatctttaattgttctgctgctttagaaatatgctcagtataggcaactgtctgaaagtattttagctgcagcaattccatctgtctgcatcccccttatttatttcaataaatatatatataccttattatgtattagattaaatgtaaatgcggatgtaagataatagcatagttaaagaaaaggaaagggtgtcatgcaatgaaaattgatgtgaaagatatagcaaaaaatttaaatacaccgctaacggctcctgcttatcctatcccaaattataaatttgttaaccgtgaatatttaaatattatttaccgaacggatgaaaaagctttgcgtgcggcagtgccggaacctcttgaaattactgaacctttagtgaaattcgaagtgatgcggatgcccgatgtttccggacttggtgcctatacagaggcaggacaagtcatccctgtcagctttaatggtgaagaaggagattatgtacactctatgtatgtagacaatttcccggctattgcaagcggacgggaacttactgcatatccaaagaaattgggcgcccctaagctgtatatagactctgatactctcgttggcacattagattatggcagtcttcgtgtggcagctgcgactatgggatataaacatttcgaaatggacaaggaaaaagcgaaaagggaaatttgccgacctaattttatggttaagattgctactgattacaatggtgatttaagggtttgcgatttggtgcgcacgcaaataacgaatatagaagttaaaggtgcctggtctggaccggcgcggcttcaattatttgaacatgctctggcgcctcttgcagatttgcctgtattagaagtcgtttcagcatctcatattattacggatttaaccttaaatgcagcacagccggtttataactacttagaggaaaaataaggagacgtttacaatgagaattgcaattttaggagcaggttctttaggaaccatagttggagcatatctgtctgctggcggaatggatgtcgaattaattgattcatacaaagaacatgtagatactttaaatcaaataggtgctaaagtagttggtacaacggcatttcaggcaaaggtaaaagccattacccctgaaaacaagtcaggcaagtatgatttcatattgctcctgacgaaacaattatataatgactccattcttaaagagttactgccttttttaaaggatgatagtgtagtatgttccttgcaaaacggtatacctgaacagaaagttgcttcgatcgttggtggtgaacgtgttattgcaggttctgttgaatttggtgctacgtttattgaaccaggcgtatccagacttacaactgagtatactcaatttaaagagtacgcttttcaaattggagaattaaatggtgaaacaacagaaagaatccagcgtattaaatcggttttagaccttatcggcggaacacatatttccgataatttagttggaacgaagtggtcaaaattacttatcaataatgcattcagtggtttatcggcagcattaaacggagaatacggtgatattcttgaccatgaaatcggcattgtcagcgcagttcatatcgcagatgagacgattaaggttggacacgccaatggtgtcacatttgcgaaaatgggcggccttgatttagaatctttggaattaaaaagtgaaaatgagattcctgaacgtattcaaacatttagggcagccatggaaccatccaggcttttaagagcaagtatgcttcaggatcttgagaaaaaacgcaaaactgaaattgattatattaatggagttattcccaaaatggcagaaggtactggaatttcaacaccttttaatgatttggttgtagcacaagtcaaatgtgccgaggaatctcaaacagtgcccaattttgatacaaatataaaagcatttgaagagttattacgtatccgaaaggaaatgtgatatataggaaagagtaagggattgctgcggcggtccttttttcttggttcagcaagtaaacaaacgggtgtgttagttacattaaagttcttcgttatgaattgaacggcgcctttattgattccttttcagcaaaaaaagcttccggcacctctctttgatgccgaaagctttttattgtttttttctgtgagcttcattgagctgtttaatgtgctgtatcgcagctttgatgccctctttggcgtccgggtaggattgattccaatgtttgacgagcggcggcatgctttttgcgatatgtgtatacaaaatccactgcctgacttcttcctttacatccgggtttgtttcgccaagcaatagttcagtgtatttctcaagcaggccgtccagctgctgctgcagtttttcttccataccgtttccttccctttttcatgattatgacaatcgggcggtgagggccgcttcctgcacgatacatctgccgcgtccgtgcggaatgcaaagcggcgtgccgaacagcggatcttgcgttacctgacagttcattgcaaagacctgctgtacaagctcgcaagtgatgacttcttcgggacggccctctgcgtaaatctgtttatcctttatggcgaccagataatgggcataacggcatgccagattgagatcgtgcagcaccatgacgattgtgcgtttttctttttcatttaattcaaacagcaaatcaagaatttcaatttgatgcgtcatgtcgagataagtcgtcggctcgtcaagcagaatgatatccgtatcctgagcgagtgtcatcgcaatccatgcacgctggcgctgtccgcctgacaaggaatccacaggacggtcggccatttcctcaagcttcgtcgcttttagcgcttttgtgactgcgtcttcgtcctctttggaccattgcttcagccagctttgataagggtatcttccctgcttcacaagctgatgcaccgtcaggccttcgggagctgacggactctgcggcaaaatagcgagctctcttgccacttccttcgtcggaagcttagcgatggcttttccttctaaaagcacagaaccgcccctcggtttcatcagccgggccaatgaacgtaaaagcgtcgattttccgcagccgttgcttccgatcaatacagtgatttcgccttttggaatcgcgacatccaattcgtcaatgataacagtctctccgtaccctaagctcagcgtctctgtagaaattgcactcataccgctaaccgctccttttttgagtttcccaacactatgtatataaacaaattgcctaaacattcaacgtgagatcatgattatattgtaacagaaattaatgactctgaatatcattatcaattagttttgggtaaaaaagcagcgggcggcggttatttttttatttccgtcattactccatcgttctttttcagttttagataaaaatggtcatagcggctgtccaaattaaaagccgaaagcacctcccggacgacctcgctttcctgcatccggccgtttacggcaagttctccgaggatcatcttcatttcatcaagcgcttcctcgccctctctgtgaacccctgagagcttgtcccggatgtccgccttttcatgaccgctttttctttcatacaaaccttcatagcggttatgctctccggctccgtagctgacgcgcagggaaaagctgctgtaaggaaccggcttctcggatgacacaggtgtgctgtcttgttccgcttcccgtttttcttcattcaatcggcagccggcaatcagcatcagcgtaagacataaaacgcccgccgttctgatccatttcatgcgattcactcccattccattccgatcgtttttaggtatttccaagggaggcggctgtcattcacggaacaaaaaagaaccggagcggtaacagctccggccggttcatctccagattatcattcagtcagctctaaaaattcctgcacatcctgtacggcaaggcggaccgcgtcttcccaaaacgaccgttccgtgagatccgctccaaggtgcttcatcgccaaatcctcaacggtcatcgaagccgtgtcacacaaaagcgcgatatatttttcttcaaaatccgctttttcccgaagagctcttgcatatattccaagcgaaaataaataaccgaacgtgtacgggaaattgtagaacggcactcccgtaatatgaaaatgcagttttgacgcccagaaatgagggtggtattcccctaatgaatcgcaaaatgcttctttctgcgccgcttccatcagttcattcagtttctcagccggaacgacgccctgcttgcgctcttcataaaaacgcgtttcaaataaaaatctcgcatgaatattcataaacatggctacgcttctttgaattttatcttcaagcaagaacaccttttcatcctttgtctccgcttgtttcaaagcggcgtcggcgacgatcatttccgcaaaggtcgaggctgtttcagccacattcatagcgtaggctctgttcagctgccgcacttggagcatggcctcctgatgaaacgcgtgaccgagctcatgcgccagcgtcgatacgttcgaagcgcttccggaaaacgtcataaaaatccgggattctccgctgtcgggaaagctggtgcagaaaccgccgacccgtttgccgctgcggtcttccgcttctatccaccgatcgcggaacgctttttccgtgaatgcggacagctttttgccaaacgtcgaaaattggctgacgatcagattagccgcttcatcatatgtgtattctttcgaagcctcgccgatcggcgcgcccacatcataccagttcagccgctcaagccctaaaagagacgcctttcgattcaggtattcggcaaaaggctttttatgatcggtaatgacctgccacatgacatccagcgtttcttttttcatccgattgatcgcaagcggctcttccaaagcgcttttccagccccgcgctttatagatttccgtgcggaagccggccagatggttcagcgtgctgctgaaaagctcctcttctcctttccaggcttcattaagctctttgaacacttgacgtctgatgcggcgatccgggtgcgccatcatattttccgcttggccgaccgacagctctttatcctcaaacggaatcttcattctgccgacagccgcattatacaggtcgccccatgcgtgatagccgtcaacggccaggccttcaatcagcctttcttctgaagcgctgagcttctctctgacccggtctcttctctcatttaaaacatatgtgagatcctgaagttccggtttttgcaggagctcctcccagacccgctcgtcaatccgggcaagtgtatcgtcaagggtgaccagagcggatttaaaatcactgctcagctgattgatccgcgctctccattcattcgctttctgatcatgagtgttctgagcctgaagacagccgacgaacgctcccgcctgcctgatcatgatcgctgaccgttcaaacctatcaatcagattgatcagctcccggctttcatccgcgtgcgtcggaactgtaaatgcttcaaccgcatgttgaaaagcgcttagatgctttttgagctcttgtatgtattgctgaaactcttccgaccggctcccgccctcaaaaatggagtttaaatcccatgtttccttcaatccctctaatgccatcttttctttacccctttctatccgaagctgactccattataaaacaattctgacatatttccgaacgatttctccttctttccgcgagatgttatacactatgagataagaacaaacgacaaacggggaggattataagatgaacagaaaagttgccattgtaaccggtgcgacgagcggattcgggatgctgacagcgctgaagctcgcccggtcttatcacgtcatcgcaacagccagacagccggagaaagctgtaatactgaaagaggccgccgctcaagcgggtgcatccgcatatattacggtcgtttctttagatgtgacaaatgagcagtcggtgtctgacttcgggaacaccatcagcggtttcggaccgattgagctgcttgtcaataacgccggcactgcgtacggagggtttattgaagatgtgctgatggaacattacagacagcagtatgaaacaaatgtattcggtctgattcacgtcacaaaaaccgtgctgccttatatgcggaaacatggcggggcgaaaatcttcaatatcagcagtatcagcggactgaccggtttcccggctctatctccgtatgtctcttccaagttcgcggttgaagggtttacagagtgtctgcgcctcgagcttctgcctttaggaattgatgccgctttaatagaaccgggctcctataaaacgtctatttgggagacgtctctctccagccatattacggcgcccggcaaagactcgccttattatcgcttttatcagccccttgaagcttacttcaaagccaacgcatccaaaagcggcgatcctgatgacgtagcggagctgatttatcaattggcacaaaggaaacggctgaagaaactgcggtatccgatcggcaggggcgttaagctgacattggctttccgctcactctttccgtggtccgcttgggaatcgattataaagaaaaagctgttcacttaaactaaattataataattataatttagtattgatttttatttgatacgtgatataattaaattaacagatcacagggaggacgatgaatatgaatacacaaaacgcgaaaaaaactgaaactcttgttgagaaatcaatgaacacacaattatcaaactggtttatcctttactctaaactgcaccgcttccattggtatgtaaaaggccctcacttctttacgcttcatgaaaaatttgaagaactgtataacgaagcagcggaaacggcggacgccatcgcagagcgtcttctggccatcggcggacagcctgcggcgactttgcacacttaccttgaacaagcttccattacggatgaaggtcaggaaaaaacggcttctgaaatggtgaaatcactggttcaagactataaacaaatcagccgcgaatcaaaatttgtcatcggcatcgcagaggaacaaaatgacccgtcaactgccgacctgtttgtcggattagttgaagaagcggacaagcatgtgtggatgctgtcagcctacttgggagaatgacgaaaaaagctgaacctcagttgaaggttcagctttttttatgcgctcagcttgcgctttcagtttgtttcgttaatgtgacgttcagcgtctttttgcttccgcttctgagcacttgaacagtcgttttatcgccgattttcagctggttatataagatctgtctgatatcggcgctgctgtcgacatctttgccgttcagttgtacaatgacgtcatttgatttgatgcccgctttcgcagccggtgagccggattgcacttcttttacgtaaacacccttagacagctggtcgccgaacagtccgagcgtgttttcctgataggtttccggaacttgcgccatgtcaatcatctgcacacctaaaaacgggcgctcgacttttccttttgcaagcagctggtcgactatcggttctacatcattgctcggaatggcaaagccgagcgactccacgccgttttcactgactttcatgctgttgatcccgatgacctggccgcttgagttgattaacgggccgccgctgtttccggggttaatcgccgcatccgtctgaatcacgttcatttccaccgtgccttgggatgtatcggcgtccaccgttctgttcagcccgctgatgacaccttgtgtgacggtgccggaaaactgctggccgagcgggttgccgatggcaatcactttatcggcaatgcggagcttggaggaatccccgaagctggccgcttttttgacattggacgagctgatttccaatacagccaagtcactgatggcatcctttccgacaagctttgccgtttcggttttcccattgtaaagagtgaccgacagtttgttcgccccttctacgacatgattgtttgtaatgatgtacgctttttcgccgtcttttttgaagatgacgcctgaccccgtgccgctttccgtttcagagcttgaaccgccgtcaagtccgaactggctgctttgcgaagcttggtagttggacactccgacaatcgcgggctccaattcttccaccatatccgctacgcttgaggtatttttcaaaggcgttgacgtaaaattcgaagactgaacttgtttcgtatcagaaacggcttctgtcttatgctgctcacccggcaggttcggcacaatgccaagcacgaggcctccgccgataatgccgcctaaaatcgggctcagccaagcggctctccgttttttttcttttttcacggcagccgttttttcaaattccgtaccggcagccgtctcgttttccggttctttcgagacggtcccttcaagcagctcgggctcctgatggctgatctgctgctgttcatttctgttttgttccgtatgtgaaagatctgactgatcgcggcttctgccgtcatctcgatgatcgttcatattcacgcacactccttcagcatgttttcattctatcgattacatattcatcgcatgtacaagttctattgtcccaataataaggagaaaagcaaagctccaaaacaaaatgtgtttgaacatgttatcttccccgctttttttcttcctttcttcccttatacacatcataaacaaacattgtgggataaaaatgaaaagaatatgtgaaattatgaaaatgcggcttgagtatgttaaaactagtataatgacgttgaaaggatgtgaaatgccttgtcatacaccatttatctagttgaagatgaggataacctgaatgaactgctcacaaaatatttagagaatgaaggctggaacattacatctttcacaaaaggcgaagatgccagaaagcagatgcagccgtctccccacttgtggattcttgacatcatgcttccggatacggacggctatacattgataaaagaaataaaagaaaaagatcccgatgtgccggtcattttcatttccgcgcgggatgccgatattgacagagtcctcgggttagagcttggaagcaatgattatatcgccaagccttttttgccgagagagcttattatacgggtccagaaactgctcgagctcgtgtataaagaacagcccgccgcaaagaaaaccggcatcaccgtttcttcctacaatgtgatcgaagatgcccgggaggtttatgatgaaaccggcagcctggtcaatttgacgtctaaggaatttgatctgctgcttttatttcttcaccataaaggacaccccttttccagagaagatatcctgctgaaaatatggggccatgattatttcggcactgaccgggtggtcgatgaccttgtgcggaggctgagaaaaaaaatgcccgggttaaaggttgagaccatttacggattcggctacaggatgatgacgtcatgaaaaataagccgcttgcttttcaaatatgggtggtcatctcaggcatcctcttagccatctcgattctgcttctcgtgctgttctcaaatacgctgcgtaattttttcacggatgaaacgtatacgaccattgaaaatgaacagcatgtactgacggagtaccggctgcccggatcgatcgagcggggatattacagcgaggatgcgaccgctccgacgactttccgatccgttcagcacgttcttctgccggagcgggaggaatcggccagtgacaaagacttgaactatttttcttcttcctttatccataaggtgtacaagctcgcgggccgccagcacagcgtcacgaaacgatacagcgcggacatcagcggtgaaaaagtttttttcgtcattaaaaaaggcctcaccattaacggccaggatgcgatgatgctgtcttacgcccttgattcttatcgtgatgatctggcattcaccctgttcaagcagctgctttttatcattgccggcgtgattttgttaagctggattccggcgatttggcttgccaaatatctctcacgcccgctcgtttccttagagaagcatgtcaaacggatttccgaacaggactgggatgatccggtcatcgtcgacagaaaagacgaaatcggaaaattaggccataccattgaagacatgcggagcaagctggtgcaaaaggatgaaacggaaagaacgctcctgcaaaatatctctcatgatttaaaaacgcctgtcatggtgataaggggctatactcaatcaataaaggacgggatttttcctaagggggatctggaaaccacaattgatgtcattgaaggcgaagcagaaaaacttgagaagaaaattaaggatttattatatttaacgaagcttgattatttaatgaagcagcgggtgcaccatgagacatttgacattgtgaaggtcacggaagaagtcattgaacggctcaaatgggcccggaaggaattattgtggagcgttgatacagaagatgcattaatgatgcccggtgatccggaacaatggagcaaacttcttgaaaacattcttgaaaatcaaatccgctatgcagaaacggcgattcacattcggatcagccaaaatcagcagcagattgtcatgacggttaaaaatgacgggcctccgattgaggatgagatgctatccagcttgtacgagccttttaataaagggaagaaaggcgagttcggcataggactcagcatcgtaaaacggattttaaccctgcataaagcatcaatttcaattgaaaatgaccaatcgggtgtaatctaccgaattatcataccaaagtagactgtagtgtttcattgcagtctttttttatgtgaaggaatagccgttaaaatctctgtagtttgctttcagcggtttttggcattgatgaacccatttcttttcacaaattgtctttttcggatatttcaccttttcgactttaattcctctgtttcgcaagcggctgatcatttcatctaattctttcattttcagattcaccctttcgccagaactttgaccattcggtcagctcactttataatataaataaaacaaaacaaaaaaacaagttacaatcaggttaaatttacggaatatcaatatgaccatatagtcatacatgagaagcacaagccagcctcctggctccgaaagggtggaaccattgaaggaaaaagaaaagctgatcattgaagcagcaatcaaactgtttgcccgaaaagggtacaaatctacatcggttcaggaaatcgccgatgaatgcaaaatctcaaaaggcgctttttatctttactttccttccaaagaagcactgctcctatccatgctgaattactactatgataaaacgtttacccgaatcacgacgatccaaacggagggtgacagtccgagagccgcttatcaaaaacagcttgcggtgttttacgaatcgattctcgcccatcaggattttattaccatgcagatgaaagacggttcacttccttataccgaagaagcggcgcagtgcggaaagagaatccgccggtcgatcctgcagtttcatatcgacagtcttcttgctgtttacggagaaaaagctgaaccatacacagccgagctttgttttttaatagaaggaatcagtcagatgtatcttgaatatctcattctgaccggccggtccgtacagccttcgcttttggcaaataccgtgattcacagaattgatgacatcgtaaacggaatggcgggcagacatgatgaagcatttatttctcttgatgaggcaagctcactgtttgggccccttcataacgggcagcccgatcctttaagccaatcgatcttgcagaccctccgcacgcgcatcggcacgatggacaaggcggaagcatctgaattcaccgagagcttggatattctggaagcggaaatgaagaaaaagtcgccgaaaccggcaatcatcaaaggaatgattttgaatttgaaggaatccgacctgctggctgaagatgcagaacagctcagatttttactgaaacagcagtttatttagaagaacggccgcaatgactgcagccgttctttcttttatgctttcgggtgcaccatatcttccggacgcaccatttcattaaattgttcttctgtcagaaggttcagctgtaatgccgcttctttcagtgtcaggccttctttgtgggcaagcttggcgattttcgcggcgttttcataaccgatgtgcgggttaagcgccgtaacaagcattaatgagttagagagattttcctgaatcgtctcttggttcggctcaataccgacagcgcatttgtcatggaaggaattcattccgtcactgagcagctgcacggtctgcaggaagttataaataataaccggtttgaagacattcagctcgaagtttccttggctggccgcaaacccgattgtcgcgtcatttcccatcacttgcgcggcgatcattgtcagcgcctcactttgcgtcgggttgactttgcccggcatgatagagcttcccggctcattttcaggaatgacgatttcgccgattccgcagcgcgggccgctggccagccatctgacatcgttggcaatcttcatcaggtcggcagccaatgcttttaacgcgccgtgaacgtaagtgatttcatcatggcttgtgagcgcatggaatttgttaggcgaactcttgaatgtctgccccgttacttttgtgatttcttccgcgacgaattcaccgaactgcggatgggcgttgattcccgtgccgactgccgtgcctccgatggcaagcgcgcggattttttccgttgactcaagaatcatttctttcgaacggtcaagcatgtatacccagccgctgatttcctgtccgagcgtcagcggagtggcgtcctgcaaatgcgtgcgtccgattttcacaatatcctgataagctttcgctttttcatcaagcgtcgcgcgcagctgatcaagcgccggaacgagctgctcatatacggcaagaaccgccgcaacgtgcatcgccgtcgggaatgtatcgtttgagctttggctgcggttaacgtcatcattcggatgaatcttcagctcggaatttttttctttcaataaagcagtcgcgcggttggccaccacttcattcatgttcatgttgctttgcgtgccgcttcccgtctgccagacaacgagcggaaagttatcgtcgtatttgccgtttaaaacatcgtcacatacagcggcaatcgcctgggctttttcagactctaagttgccgaggcgttcgttggcgatcgctgtgcttcttttcaatattgcaaacgccttcacaacacgctgaggcattttttctgaaccgattttgaagttctctttgctgcgctgtgtctgagcgccccaaaatttatctgccggaactttaacttctcccatggtgtctttttcaattctgtagtccatttatgtatccctccataacagttgcttcaccctgagtattattcgccagtaacagatgaaaccctttttatttttcggccttggccgtttttaatttcagctcaagatagacgcgcgaatccttagagtatttatacttcggatttgttttacggtattctttcgacgtgtaagccacttcgtaatgcgcttcaaatgatttgatgagctgttcaatttcttcggcatttcctgccagtctgacttgtgccacatctctcctccgctttcataaaaaaacttgtaccattaaatactttatcatagtatatcatttttttaacaggaaaagataacctcaattaaggattggaaggcgggtgactgtcgatgacgcaatcggagttcaaggaatacatacacgttaatctggcactggtgcttccccacgtagagcagaatgatgacctggttcaaaataaaaagatgcttccgaacgggcttgttttttattatatgtatctgagtgaaatgaacgacgaagacaaaataaaagaggcgattgaaacgctgcttcaggaggaagacactctgacgctggatacggtggcgaaacgtcttgataagatcaacgcccgtcccgtctttacgtcgaaggaagccgtcatctccattctgcggggaaaatgcgccgtgtttattaacggacttgacagcgtatacattttgtccacgggaaaaagagaaaaaagaagcgtaaatgaacccacatccgaaaaggtcgtaagaggtccgaaaatcgccttcatagaagattctgatacaaacatcgccatgatcaggcagcgcacgaaccatccgaagctgaaaacgaaaaaggttccgatcggagaaaataagttaaaatacgccacggtcatgtacatagatgataaggcggacccgtctgtcgtcagcgatgttgtaaagcgcctcagcaaagtgaagatggatgacatccaggattccggaacgcttgaggagcttattgaggataataagtattcgccctttccgcaaatacaaaatacggaacggcctgataaagtctcttccgccttgttcaacggccgcgtcgccatccttgtcgacaactcgccgtttgcgctggtggttccggcttctttaggaattttaatgcagtctcccgatgattattatgaacggtggatttccgcctcgctcatccgggcgctcaggtttacgtctatttttatcacgctgtttttttcgtccatttatatcgccctcgtttcgtttcaccaagggctgctgccgacgtcgcttgcagtcaccatcgcggcgaacagagaaaacgtccccttcccgcctatcattgaagcgatggtaatggaaattacaatcgagctgctgagggaagcgggcttgaggcttcccagcccgctcggccagacgatcggattggtgggcggagtcgtcatcggccaggcggccgttgaagcgaatattgtcagctccatcatggtcatcgtggtcagcattgtcgcgctcgcttcatttacggtgccgcagtacgggatgggtctgtcgttccgtgtgctccgttttatttcgatgtttaccgcggcagctttcgggctgtacggcatgattttatttatgctggcgatctacactcatttatcgagacagcgaagcttcggttctccgtatttctcgccgaatggatttttcagcttaaaaaacgcaaacgactctattctccgtctccctattaaaaatcaaccaaaagaggcgaaaaacgtaaatgagccagaaaacaactcacaataagcttacaagctatcaagggacagcattgattgcaaacacgatgctcggcgcggggctcctcaccatgccgcgggcgctgtcatccagggcaaattcgccggacggctggatcgcgttatgtctggaaggcgtcatctttatctttttgatttatctcaatacgctcattatgaaaaagcatcagtacggatcattatttgattatatgaatgaaggactcggcaaatgggcgggaaatatcgtcaatctgatgatctgtctctattttataggagtcgccagcttcgaagcccgggcgatggcggaaatggtcaagttctttttattggaaagaacgcccgtgccggtcacactgtttatctttatcgcctgttccgtttatttaattatcggcggcatgagcgatatcggcaggctctttcctttctatttaacgattacgatcattattttgctggtggtgttttctttcagctttaaaatatttgatctggacaacctgcggccggtgctcgggcagggattttctcccgttatggcttccttgaccgtcgtttctgtttccttcttgggaattgagattatgctgtttctccccgagtacctcaaaaataaaaagcacacattccgcatgtcggccataggctttggcatcccgattattttatacatcattacctacgttctcgtcgtcggcgccttaaccacccaggatgtcaaaacaatgatctggccaacgatcgcgctctttcaatcatttgaaatcaaagggctttttattgaaaggttcgagtcctttttgcttgttgtctggatcatccagtttttcgccacctatgtatcatacggatatttcgcgacatcagctcttcataaaattttcgggctgaaacagaaaaaaggcatcatcttcgtaggcatcgcgacattcttcggatcattgttgccaaaagacggaaacaagctgatgctgttcagtgatattctcggctatatcttcttggttttctttttgctgcctttactgatgtttgcagtcgtcgctgtgaaaaggaaggtgaaaaaagcacaatgaagaaatacatcgtaatcatattttgcacattgcttttggccgggtgctgggacagccgcaatttagaagacttgagcctcgttatcggagtcgggctagataaacccgcggaagaaaatgtggaagtgacacagcagattctggttccgcaaaaagcaagtgcccagcagtcgtcgtcaggtgacacgacaaaggtgacttccactccaggggaaaccgtccatcaagcattaagaacggcatcgttaaaaaatcaccccgccttctcccagcacttgcgtatcatgctgttttccgaagcgctgttaaaggatgacattccgcttgacgcattgatgaaccaatttatcagagacaacggtacgagaagaagctgcaatgtgatgacggtgccggataaaacgaaagatattttcaatatcagtgaccagggagaacctgcgtcaaatacgatctatgacttaacggagaataattcggtcaccatccggatgatggagcccgtgacattgggggaaatatcagagaaaatcgccaagggcgaaacctttgcccttcctcaagtgcgcaaagtgggcagcagactggaaatctggggcgctaccattattaaaaataaattctggtatgcaaatttaacgcctttacaagtccagaatatgaacctgttcacaggcacggtaaagggaggcgtcacgtttgcaaagcatgacaattattatttatctttcgaggtattttccagcaaatataatgtaaaaacacaatataaaaacggaaaattcaagtttatcgtcacccggtttgttgaaggccgtctgtctgaggattggaatccgaaagaagattctttcaaggagtcctatataaatgaaatcaaaaacgcggtaaaacgcagcattcattcagatgttatggcattcattgattacatgcagcatgagttgaaagtggatattaccgggttaggcgatcaagtccggattcattatcctgataaatggaaaaagatatcctctgactgggatcatcacttcagtgaatcggatattgaatacaaagtcaaagtcgccatcagggatttcggaacaaagggaatgtcccaatgaccccgtccctcgggagagtgtgccggcgccgctctcctttttttatgtcacgagatgattgcggtgggcatatacggctgcctgcgtgcggtcactgacatcaagctttgacaatatattcgtaatgtgggttttcaccgttttaatcgtaatgaacaactcttcaccaatctctttattcgtcttgccttccgcgacgagacagaggatttccagttctcttttcgtcagcgtttcatgcggaagctgattctctgaatggcgcagccttgacagcacttttcccgccactttcgactcaagcttcggttcacccttggcagccgctctgatggcttctgctatttctgccgccttggacgttttcagcaaatagctgagcgctcccgcttcgatcaccggatacactttgtcgtcatcaataaagctcgtcagcacgatgattttcgggtcattgagtttcgcgcagatctgttttgtcgcttcgatgccgtccatgccgtccatgacaaggtccattaaaatcacatccggcaaaagctctgcggccagatcgacgccctgctgcccgtctgatgcttcaccggcgacttcaatgtccggctgtgcttctaaaaatgcggccagacccatcctgaccatctcatgatcatcaatcagtaacactcgaatcactgtcgttctctccttttgttttctgataaatcgggactttcacgtcgatctgcgtgccttttcccttcacggagataatttccgctatgccgccgatttcactcgctctttccttgatggaatgcaggccgtatgaggatgctttcacttgatccatcgtaaaaccctccccgttatcaatgactttaagctgcagcttttgatgtttcgcgccgagcctgacggtgaccttggtcgcctttgaatgtctgaaaacgttggaaagcgcctcctgcacgatgcggaacagatggtcttcaacaccttttgacacacccgtatcgctgatgtcccactcaatatccagcggctgcttcgctttgaactcttttaacagctcaatcagcccttcttttaagccttttccttctaaagtgacgggccgcagatgcaatagcagcgctctcatctcgttttgcgcttcccccgccatatgttcaaccatgcgaatccgtttgacgattttgtcatccgcatctttcacctgctctaagacggcggatgtcatcatagaaatggcaaagagctgctggctgacggcatcgtgcagatcgcgcgccagccgctggcgttcttcagtgatgaccgattttttcatttgatcctgccattccgcccgctcgttggagagtttttgcagcgatgtgacctggagctcgacccgcttggccatttcgttaagctgatctgccgccaggccgatttcatcatcgccgagcggcggcacccgataagcgaaattgccgttttcaaatttcaaaaccgcttcaatcagtgtatccattcttgttttcaggcggccgccgtatacataaccggaaatcaatccggccgaaagagacgccagaagcaggatgaccacaaacggaataccgaaccagccggaagaaaacagcagcatcgggtcaagcccgtaatacagcagcatcagcgtaataaacaccgcacaaaggagcagactgagccccgcagtcatccgcatggcgcgccactgaatattggcgagtaattttttcctcataaatacttcacatccacatcgccgatgaataaagaaattgaaattttaatccgccgcggcgagtcgccgtactcagacgatactttataaagattcgggctcatgccgcttttcttagagccgagcaggttcatatcgccgataaaagccgatgaactgacggacacttcgatatccggcgggacgtacacatcgacattgccgatgacaccgctgatggtcatcgtgctttctccttcgggaatcatcgcttttgacaaatcaattttcacatcgccgatgaatccggaaacatttaaatcattcagctcaaacgggtccttcatcatccggagctcgccgataaaaaagctgcggaggtccggctgtctgctttccgtctgggcggaaggctttggctgctcttctttttcaagattgattttcttctctttatgttcatacacgcgctttcctttcaggagcctgtagcccgcgtatatgagaaaggcggcgaaggcatagccgaacaggttaaaggtggcgctgaacaggttcctcaaaaataaaaaagcggcgaagatatacaggacggagccgagccagccgcgggaatatttattaaaaatatagcctgtgatcagaaaaaagagcggccaaaacaagaagtcgccgatgccgataatacgcaaaaacatgctgacgcctaataaggcgatgataagtccgagaatctgtttttttgccatcagctgcctgcccctcctttccttgactattgcagtgcaatattgccgctcgtcacttttatatcaatcggcctggcgccgctgcccttcataccggtgaatgccccgccgtccttactcgttttctcaaaggaataagacggctgaatccttccgcttgccgtctcggcgttcaccgtaaaacttccgtctttcggcaggctgatcgctgcgctgccgctcgcaagcctgacggatacgggagcatccgccatctcaagcgaggcgtcgacactgccggaagcgacccgcacgtcaagggcgcccgccgcatgttgaagcccgacatgtccggaggataagcggatatcccccgttttcgccgcaaggcctgatgctgtgaggttgcccgacagccctttcgcttcaaacacatccgtcttcacgtgcttcagcgacatattcccgcttacagaacggacgccgaggtgcgcaagagacagccccttgtttccgtcaacggcaatggtgccgcttgacgtatggacggtaatgtcccgatgataatcatacggaatgcggacaatcagcagaggacgctgaaagagattcagaaattggaaccctttctccttcgctttgagattgagggtttttcccctgctttggacaaacattttccccgccggtcccgccatgtttgccgcgatatcattccgcgcttccgcgatgatttttacatccgtctgttccgatgaaaccgacaggctgttgacggcacgcggcggtatgcttgccgattccgcttctgtttcgtacagcggaaaaaaacgcccggcaaacacttctttcaccaaaaacagacagcagatcagaacggacgccgccatcagtcctttggccatcttacgcttcattacgttccatcctttttcattcattttattataaaggaaaagccggagaattgatacgtgcgtatagggaagaggcgtaaaagcgccgatcttcccttgtgcacattattcatgagccgctttttgatgctctgttttctccagagaaagcgagcgcattttttcaatctcagcttccacctcgtctgaatattgggagcggctgtattctgtgttcgcctcagctgaagtgccgtatttgacgcggacttccatttcttcaatgcggctttccattcgaagaaactctctgtaggcgctttcactgtcaattttgtcgaaagaagcgttcatatgttccttcgcttttgccgcgttggcgcgggcgatgagcgcctgttttttatcctttacgtcgcggaggcgcgtttctaaagtttccagctgctctttcagctctgccagctgtgttttcgcctgctcatacgctttttcatgttcggccgcttttccctcaaggtatttcatttcagtcagcgcctttttcgcaagctcctcttccccggcgtcaaaagcaagctgagcctggtttttccgttttgccgccgtttcggaagcgtcttcctgttttttcttaaactgatggacgatcgtgtgctgtttgacaatcgtttgtttcgccttagcaatgtcactttccatatcacgcacatattgattcagcatgactttcggattttctaatttatcaagcccttcgttaacagatgcgacgaacatatttcttattctttttaagaccattttgtcttcctccttattttttcttcagaaattcttcccattcagagtcaaatccggattgatagcccggtgatgccgcttccggttcatactggcgggaagcggtgtctgagccgccctgcttcatcatcttccacccgaaatacaccatggcgccagccagtccgatggcaacgataaatggaagagaaccgacgagaatcatagctccgatgaagcccgcgatgatacccgataccgcccggccttttgaaaaacgtttgattccccagtaaagcatcaggcctccgatcgccagcgggatgataaatgcgaaatggcctcctccgaaaaagacagaaagtccgaacacaatcagcagaaagccgcctgccgtttttacatttatattcatgcagatcctcctttcgttttccttgtctttactataaacaaatcccgcggccggcaaaacgagtcagagattgattttcatatcagaccggagtcgtataacccccggaccttcgcataaaaaaacgccgctgcaccggacggcgcagggcgtttcacgaaaaatctatattctgatgctcgcttctttttccctgatgagatctgagcgttcagctttggccagcttcgtaaagagcaatattccgagaccggacaggacttcaacgagaccgccggcggcaatgacttttccgggaccgaaggcgttagccgcgtatccgcaaagaaccgcgccgagcggaatggatatgtttgagatcatatggatgacggcatagacttgcggctgatcatcatggtccacagacgtctgaataatcgtatattccggcacattaatcgcgctgacggcagatccgaacgcaaacgcggcgaggaagacgagcggcagaaaagtgttgaggccggtgatgaaaaatgccgccccttctatgattcccgctgacacaaacaggagaccgtatttgttcaccttcaccttagccaaaataaaacccattaaaaaggctccgcccgtgcctgtcgctttcaaaagcgagtagatgatcggcggcatgtttaaatcttcggcgacataaacggcagagagcgcctcccacggagcggccgcaaaattcatgaagatacaatagatggcgagcgggtataaaatctggtgtttcctgacaagaacgaaaccccgtttgagccttccgacatacgtcccgcgctgtctgacggcgacggtatcctctttggcatgctggacttggtatgacataaagagtacgagaaaacctgatagaagatagaatataagagcgataaacaaagaataagcgggactgataaatgttaagaacaccccgctcagcgtaatggcggcaagtctgacgatctggcctgatgactggatgaccgcattcgctttctgcaggctgttttctccgacaatattggggattaatgagatagatgcaggattataagcggctcccgtggctgaatgcaaaatcatgagaagcatgacaaaccataaaggagaaaaaccgttaaagtaacagaccggaatgatcaacacgaccgccgcgcgcgtgagatcggagaaatacatccagaatttcagcgtatgctgcttcataaaaggcccggtaatcggcgccagcatcgcctccggaaggaacgtgaccgcaatgagcagggacgtgccgatcgcgccttccccgtcaaaaatcaaaaaccacagaatggaattaaaggcaaaaccgtcgcctgacaatttaacaagcctcgagataaacagaagggtgaaatttttattccagatgctctcgctcttattatatgtatccatctatcaaatcccccattattttacaatgtttcttataatatctcattttttaatttttcagtcaataatgcataagatacattttccttctgtcaataaaggttcaattgatggatatctctataaaaaaacagccggcttgctgctgccggctgaacaaaacgttattcatcatcacggaataccgcggcgcttctttcatactctatatcctgaacgccctgtcttgcgttaactgctcttgccgccgcgaaaaaataatcagacaggcggttcaagtaacgcatcaccgtatcgtttatctcttctgttttgcccagtttcacgacgagacgctcagcccgtcttgtgacggtccgcgcgatatgaagctgagcagccgccttatgcccgcccggaagaataaatttctcaagcgggggcgcttcagccgtgtaacggtctatgcagtcttccaatgcggaaatagatgtctctcttaatgtatagcttctatgttcagtgaccgtcgccaagtcgccgccgcagtcaaacagctcatgctgaatgtttcggagttcggctttcacatcaccgcaattctcacaattatctagctccgcaagcgcaagcccgataaagctgttcagctcatcgatcgtcccgtagctttcaacccgcagactgtctttatccgttctgccgccgatcaggcttgtctgtcctttatcgccggttttcgtataaagcttcattgttgtattcctccttcttccgccgcttttacacataccgcggttcctcttctgacggctctttccgcgtgagggacgtccattgcctctcctgtctgcaaggcacaaatggcaatgtcgccttttgccagtctgccggaaagagcctgcattctcgcttcagccgctgccgttaacagccgaacaaatccctgttccgataaacgtccgctgatcagcacccaaacggtatactgcgcagtcacggctatcgtaaccgaatcaaacgtacggcagatcaaaccagctgccgccgagccggaaagccggcggctccacgaaaagcccgggccgtcagatgcggttgacagcattctaaacggccgttctgtatgaagcgttacggtatttccgcttttgtttatcagagaggcgaacggaacgccggcgggctctctttcctcccgcgcttccggcatgaaagcgatcagcggtttcggcgacgattgccgggcaacagcgctgacggtaatgccgtaaatgtcttcaatcgtctcttttttcaaagcctgatccggtggctgcttcggaaaagcgcgtccgtctttcatcatcaggagctgatcacaatattggcttgcgacgttgaggtcgtgaaaaatactgatgaccgtcaggcctctttctctcgtcagccgcttcaccgtatcaagcaggtctttttgatatttgagatcaagaaaggtcgtcggctcatccagacacagcacctcaggctgctgagccagcgcctgcgccagatagacgcgctgccgctcccctccgctcagattgcggacggattgctgtgcatatcggtcgatgcccgtcatttccattgcttcccggacaatgtcttcgtcatgttgatccatctgtctgaagagtcctttttgatacgggtatctgccgaaggacaccgtttccttaacggtaaatgtaaaagcttgctccgtatgctgcggcaaaacggccataattttcgcaagctcccgcggcttgtatctgcccgcgggcctgcctgcgacgagcacctcgccctttgacggagagagcattcccgtcagcaatttcatcagcgttgtttttcccgagccgttcggaccgagtatgccgacaaattcaccttttccggcggtaaaactgacatcttctacaatcatccggcctccgtacccgccggacaggctgctcaccctgatcataagcgtttccctccatgatgctggcgaagcagaatcaaggcaaacacaggcgctcccgccaaagccgtcataatgccgatcggcaattcgacaggctcaataacggtgcgggaaaacaaatccgccaaaatgagaaacccggcgcccgtcaatgctgacagcggcagtaaatggcgatgatccgtcccccacaaaagccgtgtcacgtggggaatgacaaggccgacaaacccgatcgtccccgagacggcaaccgctcctcccgtcaacagagatccggcggcgatcatcagcagttttctttttcccgtactgacgcctaacagctttgccttttcttctccataagtcataatgtttaattctctgccattgataagcagaagcgccgtcccggccagaaaaaaaggcagaaacagcgcgacatagccccagcccctcattgacacgcttcccaacagccagcggacaatcgggagcagatcatttcccgttaaagcaatcacaagcgaaatgagagccccgagaaaagaattcataatgatgcctgtcaaaatgagcgtcgaaaccgacatcgacgcatgaacgaggcggctgaaaaacagaaccgccgccataaccgcaatggcagcggcgatgctgacaaccggaagtgtgaaccggccgatgacgggaatctgaatgccgaaaaacaaggtgataacggctcccgccgaggctcccgaagataccccgagtgtataagggtcggcgagcggatttttcagaagtccctgaaacgccgcccccgcaatggatagcgcggctccgacaagagcggccagaacgactctcggcaggcggatattgatcataatatttacattcatgggatcaacagaggatgtccggccgatcccgatccaaaaaacgtcggataaaggaatatgcagactgccgattgaaatgccgagtgccgtacaaacggctaaaaacagcaggctgaccgtgtaggccagcgggcggttactttttaaacgtttcaggataaacgctttctgcaagcttctcgacccctttgacaaggcgcgggcctgagcgtgtgacaaggtcaggatcaacagaatagacattgtggtgtttgaccgcattgacggcaccccagccggcgcgtttttccacttcagcggcctttacgccgtctgtcgtgatgataacgtccggattcattttgacaatcgcttcatccgtcagctgcacccagccggtctggctgccggcggcgtttttcgcatgtatatcttcaagcatttcgttcataaacgtgtctttccccgtcgtgtagccgtcaggagacacttcgacgaatactttcttttcgtctttttcagaaatggccgccgctttcttttctatgccggaaaggtcggatttcatcgattggatcagctgatccgcctgcttttctttgccggccgcttttccgatcatgctgattgatttgtacacatcttggaacgattgcgcatcattgaccgttaagacggtgatgcccgcatctttcagctgcttcatcgcatcggcggaagcggacatagaggacgcgtgggcaagcacgagatccggcttcagcgcgatgactttttcagcgttcacattcatatctccgactttcggtttttttacggcttctttcggatatgtatcatttgtcgtgacgcctgcgaccttatctcccagtccgagcgcgtatgtaatttccgtattgctcggcatgagggaaacgattttttccggtgcctgctttatggttactttttcgttcgcggcatccttaatggttaccgggaatgcttcggttgagacggctttttgtttggccgcgcttccttcttcctgtgcgccggaacagccggcgatcacaaaggcggtgaccaagagcgccgcccagacggcagtgatcttcttcattcttttaactccccctgattatggtaaacgattgtctctttgacattcgtatccttttttcgcagtaattatactataagtctttaaggcttgtatatccggcctttttgcatgaaagcaaattgttcgtacacactaaaattcatcatgtatactgttacacaatggtgtaataaggaggattatcatggaattacagcttgaacgaaagctcgtattgattacaggatcaacttcagggatcggaaaagccgcggcaaaaagctttttagccgaaggcgccgaggtgattgtaaacggaagaaaaaaagaaaccgtggaacggacggttgaggagctttccgcttacggaacggttcacggcatcgctgcggatttatcgcgtcaggatgaggcggatgacctgatcaagcgcgccggcggaatcggggaagtcgatattctcgtcaataatctcggtttttttgaagtaaaggacttcgctgaggtgtctgatgacgaatggactcggtattttgaagtgaatgttatgagcgccgtgcgcctgtgccggcgttttctgccgcaaatgcttgaaagaaacagcggacggattttgaacatctccagtgaagccggagtcaaaccgcttgcgcaaatgattccgtattcaatgacgaaaacggcgttaatcagcttgtcccggggaatggcggaaatgacgaaaggcacgaatgtcacggtcaactccgtgctgccgggaccgacatggaccgaaggcgtcgcttcttacatggaaggagccgcaaaggctgccggagaagacacggacagcttcgtccgggattattttaaagtgaatgaaccgacatctttgattcagcgctatgcaaccccggaagaagtcgccaatacgattgtatttctcgcttcatcagctgcttctgccattaacggcaccgcacagcgggttgaaggcggcatcatccgctccatttaacacaaaaaagcccggcacaaggggaacttccccatatgccagggcttttttttacatcatgcctgcaaacggaaccggctcccagccgcccgtctcaagctctgctgaaaacaggccgcccgcatgcggctgctcaagtctttcggcttccgtcaatttttccgtcgcggtcgtaatgtataacgtgttcaaattgctgcctccgaacgcgcagcaggtgacgtatttcgccggaacttcgatagatgcaatttccttatgcaaaaacgggtcaatccggacggcgcggccgcctccgaacagagccacccacagcattccgtcacggtcaatggtcattccgtcgggagatccttgcgactccggaaagcggtagaccgttttcggatctgatacggctccggtttcaggatcatatgcataacagacgatttcctgcgtcggagtatcaatatagtacatcaggtttcggtcccgatcccaatccaaaccgttcgaggtggagacctggtcttttattttggcaaggctgccgtccgtattcagacggtacagcgaagcctcctcttctttgccttccatgctcgtcgttcccgcccataatctgccggacgggtcgcattttgcgtcattgaaacggatatcttcccgcatgtctttcggctgcttcatcttcgtcaatgtgtcttcccgcagattgtacaggtaaaacccgtctttcatcgtcatcaccagctcttcctttgaatacaaggccagagccgtgacaaatgagttgaatttaacggaacggttgattccgtcagccggagtgaagatatggagctggctgcccagtatatccacccagtacaggcattccttatccttgtcccataaagggccttctccgataactgctctcgtatctgctcgtaatgctgcttccatgtgtgaacacctcttttgcttgtcagtcttctattgttattcccgacaaagcggcgtccaaactcaatcttttttaaaaagaatcgtaatcaccgttccggcgctgattctgctgttgacatggatggttccgttatgaaggtgaaccagctctttggcaatggcgagcccgagtcccgttccttctgacggccccttcgtattcgttccccggtaataacggttaaacagctggtgaatcgtttcatcgtccattcctcttccgttatctttcaccttcagaatgagctgttcggctgattcctcaagcaccacccgaatggcggtccccttcttattatgcttaaccgcgtttgccagcagattctccagaatacggcggaaccacgcttcatcaatggcgaaaagaatgtcttcctttttggtttcaaaggcgatgtcatagccttccgagaacgtgtttttcgtaaaatcgttcgtgacgtttctgataaacggcacgacgttgatcagccgccgttcgatcgggagggccgcgtttttgaggcggtatgttaagtttaagtcctcaatcagcttagacatatattctgatttttcccggacgatctgccccatttctttgacttcttccggtgtccagtcgtattgcttcgattcaagcatcatgctgtagccgtaaatcgtgctcagcggggtttttaagtcatggctcagcccggcgatccattcttcccttgtcgcctggattttttctctgtttttcttatcccgcttcagcgtgtcggtcagctgatccatcgattcgaaaatctcggcgaaaaagcggaacggctgttttgttttgccttttttgtttttgctgaccggctgtcctttgcggttcttcggctcttcaagccggccctttgataaattgacaagccatttgatggtatgaaacagcggccagccgaaacggaaagagtaccagatggtcaggatgcagatcataaatactaagattccgatcaagaggaagagggttttcatcacatttctcaaaaatgatttgttaaactcgtgatcggggatgtacacggggttcggcaccgacgcgaccatccatttcgttttatcgagtcttttaaaagaaatttcccgtttgtaattccacggcttggaactgtatttcagcaattcaagctcattgacggtgttccgttcttttttcgtgctgttgatatccccgagcagtctgccgctgttttcgagaaggtagaccgcccctttttcccgtttaatataatcaaccgtgctttttttatattgagaaagggaagcgagggatggctcctgtgattcgatgtaagtgagaagctgctcactggcggatttccagccgaacagaatcaaataggtctcatcatttatcgtgaccgtccagtaattcagcttgtagttgtcaaaattccggtactggtaaatggataagaggtcttttctgctgtaatggctcgggacgtctttcggcactctgtatgcgtagtccgttttttctttgtcattaatgatctgcagccagcccttctgctttctgaccgacatctttaaaaattcatcgacatcccatgtgccgtcttcgtttttatcaagccacgcttcaaacgagtctgccgtcgctttggtcagtcccgcattggcttccgcttcgctgaaacgccaatccaaatagaagaaagaagcgacggccaaaacggacatcagcaggatgacaagcagaagctgtccgaaaaagtggagcagaaattttccgcgcattctcatgagcggattcctttttctccttgatcgggaataaaccgatagccgaggccgcgcaccgttacaatataagacggattgctggggtctttttcaatcttttctctgagcttgcggatatgcaccatgacggtgttgttatcgccgtaagacggatatccccacactttttcatagatctgatcttttgagagcaccacatcagggtgttcacagaaatattgaagcaattgcagaagctgtgcggagcagctgacgggctcgcccccgacgatcagctcggcgttttgcggcgaataggaaaaatggctgtatgaatacgtttttaccgccgttttctcttcgcgcttataggttctttttaacgtcgctctgatccgcgccgccaattcgagcggattaaacggctttgttatataatcgtcagctcccaatgcaaatcctgacagcttatccgcatcagaagaacgggcagtcagaaaaaagatcggagcgtcggtataattccggatttcggtgcatgcttcaaaaccggacatgccttccatcatcacatccagcacgagcagatccgcggtttcatgtttaacaaactcaatcgcttcctcagcgcttccggctgtcttaatgttgtgatagccttctttgacgagaacgcgtttgaccatatcaacgatcgccttctcatcgtctacaattaaaattgacgcattttccaccttggacgttcctttctctttgtttttttcatcatatcattatatggataagatttggtacctttttagtgcggaggtcttgcggggaaacagaaaagaaaaacgagacggacatctcttctcgtttttctcacgttgtcagagcggaatatccatcattccgccgcttttgtcaggagctttcatttataagatgaagaataaattcccaaaaacccggcacttcctggcataacagcatgtccgctttttcaactattttaatcttcaattcttgttcaaggtcttctctttcctggtatgatgtattgctcagtttttttttatcattggcgaaaaacgtgaaatcaaaagttccatttcgtcggtatctgtgttctctttgttgaagtcaaatggcccgttcactgcttattttccccctttttttgcttgtccagctgctttctgagattgtcgagcccttttttatgaatattggaaatgttctgccgtgattcacccagcgactcggcaatctctttcatcgtcgctccgtgaagataaatattcgtcagcacgcttttttgtttatcggttaacgtctgaagcgcttcgtataaatcacggttttggacatgctggctcaaatctccctgcttccgcagaaactcttcatacgcgtcttttcccatttcatagggaagcgcttcacctccctccggctgatccaccgtcagcggatagcgattctgatttttacggatgcgcttgtcaaaatcgatggagaaaatccggatcatagagttcatatatttgatgatccggatttccttataaaactgtttaaaatggtcgtccaatgattttgcatccttctcgtctgaatgttccagcacatttttaaatttctcgtaatgctttgggtcacttaaaaaatgtttaacgatcggatgtttcataatttccttgcattttgaccgtaaaagaacttgatagtccataaaaccgccccctatttaaattaaatgaaagaaagcaaaaaaaagtaaactactcctttccgactaagattccgcattccttatgtcccggatttgccggaacaaaaaaaaagaccctcaaccgggatatcaggtttacaggagccgctctttctttcacttatatacatgactgcaggtcaagtcaggaggtggctgacaatggatcaggtttttatagaagaagcggtcagacagatcggcaatctcggctttccggctctgattgctatgtatcttctcacacggtttgagaagaagtttgacgccctgatcgaactgatgacggaactgaaagatcagaaaatgaaaaattaattttcacacgaagttgacttttcatcggaacgcatcacttaacaaagcagaagggaaaacgaaaggcctttcacattctctttctgaaaaaacaaagcttgagaggagacgatttacatgtcaaaagaaaacaactgcaatatcccgcagccgatcagaggagacaaaggagcgaccgtcacgattccgcgcaatcttgaaagagaccgccaaaatccggatatgctgacgccgccggaaacggatcacggcacagtggataatatgaaattctctttctcagatgtgcataaccggctggaaaagggcgggtacgcgcgtgaggtgaccgttcgcgagctgccgatttctgaaaatctggcatctgtcaacatgcgtttaaaaccgggcgccatccgtgaactgcactggcataaagaagccgaatgggcatatatgctgacgggcaaagcgcgggtcacgatcgttgatgaacagggacgcagttttatcgatgacgtgaaggaaggagatctgtggtacttcccgtcaggcctgccgcactccattcaggcgctgaaagaaggctgtgaattcctcttggtttttgatgacggttccttctcagaaaacagcacattccaagtgactgactggcttgcccacacgccgcttgatgtcatcgccaacaatttcggggtttcagaaaaagacctcgccggcctgcctcggaaagaaaaatacatctttgaagagccggttcccgggaagctgaaagacgacattgtggaaggcccgaacggcgaagtgccttatccgttcacttaccgcctgctcgatgaaggtccgactgctgagacggaaggcggcaaagtatatatcgcggattccacaaacttcaaagtgtccaaaacgatcgcttcagcgcttgtcgtggtcgaaccgggcgcaatgagagagctgcactggcatccgaatacgcatgaatggcagtattatatttccggtaaaggacggatgacggtttttgcatcggacggccatgcaagaacatttaactatcaggccggggatgtcggttacgtcccgttcgcaatgggccactatgtggagaatttgggggatgagccgctcgtcttcctggaaatcttcaaggatgaccactatgccgatgtgtccctgaaccaatggcttgccatgcttcctgagaaattcgtccagcagcatctggatctgggcaaagactttacggatattctttcgaaagagaaacaccctgtcgtcaaaaagaaatgctgaagatacacacccgacttgcagagttccgtctctgcaagtctcctctgtgtgaaaaggagctgaacagatgatcaatcaaaacgggacgaaaatgttttttcttcaggtgctccggtatgccctggcagccgctgccgtattattcgggtatttcatcgtgatgatggccgtattttcattagccgggacgagctacggatcgatggcgtacgtcctgcttttttccgtgctttttattcttctcggtttatgttttgaaccgcttgaacggctgatgatacatagctttaccttttttgggacgggcaggctgccttttctccttttagccggcaccgttcagctgctgttcctctggatgactgcgtatacgacggataaactgattgaaaagatttggctgtcaacgacggaggagctgattgtggcgggggtttttttcgttttggataaatgcgtctccggacaaaagcagccccgggcgcactaaaaaaacgcaggccggaatggctctgcgttttttttcatcttacagttgcgttttcatgccggattaaatcgtaggttaagcagaccggtttgttcgtgcgcggatcttttacaatctgtgcgtcaatttgaaacacgtcttccaatataccgggagtcatgacttcctccgccgttccttccttgatgacgcgcccttttttcagcgcgatcatgtaatgggaaaaacgggcggcatggttcagatcatgaatgaccattaaaatggtgcggccctgctccttgtttaatttgtccagcagctgcaaaatttcaagctgatgggcgagatctaaataagtggtcggttcatcaagaagcagcagctccgtttcttgagcgagcgccatggcgatccacacacgctgccgctgccccccggaaagcgcttcgatcggccggtcgtaaaattcggccatccccgtctcttcaagcgcccatttgatcatgtcacggtctttatcactcaagcggcccattccggactgatgcggaaacctgccgtaagaaacaagttcgtacaccgtcagcccgctcggcgcttcaggcgtctgcggaagaattgccatttccttggcgatgtccttcgtggatttttgcatgatcgcctgtccgtttaaatagacggcgccggatttcggtttcatgattcttgacatcgttttgagaaccgtcgattttccgcagccgttcggaccgatcagcgttgtaatttttcctttcgggatggcgatatccaattctttcgctatcaaacggtcgccataaccgacagtaagctgttccgccgataatgagttcatcgcggcagtctccttcctctatttcgttttcatcagcaaatatacaaaatacggcgctccgagcacggaaatcaccaggccgacgggaacttcggacggtgcaagcacatttctcgccagcgtatcggcaagcagaaataaaaatgctccgatcaaagctgaaaccgggataagcgtctggtggcgcggcccggtaagccttctggccaaatgcggcgcaatgagtccgagaaaagcgattccgccggctgccgcaacacatgacgcggtcagggcaacggcggacatcagcagaacgcgccgctccttttcaaccttggtgccaagccccgccgccagctgatcaccgagctggagcacatttaaatacctggctttatagaggctgaacggtaaaagaaccagcagccacggcaaaatggacagcaccattttccaattggcgttccaaatcgaaccggaaatccatacaagcgcctgcatgaaatcccgcgggtccattttcagctgaaaaatcaagagaagcgcattaaaccccgcattgacaccgatcccgaccaaaacgagccggacaggtgaaacgccttttttccaagccagcacatagatgagcagcgcagccagaaaagcccccgccaaagcgctcaccggaagcagccatgtactggccatgcttagatcaacagctgacccttggaaaaagaagataaacagaacgaccgccaaagacgccccggcgttaataccgagaatgcccggctccgccaagtcattttgagacacgctttgaaaaatcgcgcctgaaaccgcgattcctgcgccgacaagcaatgacagcaccatgcgcggcagtctgaattcaaataaaacgagctgatcccgggcatccccctgtccgaaaaagacacgcatcgtatcaagtggcgcaatccggatcacacccatgtttaagctgataaaaaagacgatgcatatgagcacaaacgtaacggccatgaccgccagcggttttttcgattttacattcattacagccctctcctttccctgcgcgccaaataaaagaaaaagggaacgccgataagggcggttaaagcgccgaccggtgtttcaaacggcgcattgacgagtcttgcggcaatatcactgaagactaacagaacggcgccgaataccgccgaacagggaatgatccacctgtaatctaccccgactaaaaatcgggtgatatgcggaatcaccaagccgataaaagaaatggctccggcgactgagactgaagcccccgtcaagaggacaacgacaaacattccgattactttcacaagcgatgtgtactgcccgagccctttggccagttcctcacccaagctcagcaccgtcactgagcgcgcaatcagaaatgccagcaatagtccgataaccccgaccgccaaaagcagctgcatgccttcccatttgacggaagcgactcctccggcataccagaacttcacatcctgggcgacatcaaaacggatcgcaatcgcgcttgaaagccccgttaagaaatagccgactgccgtaccggccagcgcgagcttcaccggtgtcagaccgccttttgaagacaggccgatgccaaacacaataagcgctccgattcccgctcccgtaaaggaccacaaaacaagtcccgccgcagacagacccggaaaaaaagcaaatgccaatgcgatcgcaaatcctgaccccgacgtcacgcccataatggaaggctcagcaagcgggttccgcgtcagcccctgcataatcgctccggacacagctaaaaaagccccgacgagcgcggcggcggcggttctcggcagcctcagatcgcgtatgatttgatgagatgtattttgcggctgaaagtgaaagagagcatcccacaccgtccgcagatgaatatcggcagctccgatggaaacagacagagcggcgccgatcaataaaaccgcaataccggcacacagcagcacagcagcccggaatgaacgcgccgtccactggatttcactccctgatgccccttgagccgtcattgtctgtttctttttcaatagacccaacactcgttcttcctttctcaaaacaagaatggtaatgataatgattatcaatgacttgtttcagtatagcacttttatcttctcttttaatagacctaatttcatataaaaaaagaaagtttttctttaaaaagagcgtgcttctctatgaaagcagtgatataatcacactgataatgattctctttatcactaatttttatgaaagaaggaatgtcagatgttccatacatacaagaaaatcggcgcagcgctgattgccgtgctgctcttcgccgctttggccgcatgcggcaattcttcagacacaaaaggttcttctgaaaaagaagaaaccatcacgtataaagccgaaaacggcaatattaaaattccgaagcacccgaaacgggtcgtcgtcatggctgacggctactacggcgactttaaacagctcggcatcaatgttgtcggcgcgccgcaaaacgtatttaaaaacccttattacaaagggaaaacaaaaggtgtcacaaacatcggcgacggcacgtccgttgaaaaaatcattgacttaaagccggatttaatcgttgtctggacgacacaaggcgccgatattgaaaaactggaaaaaatcgcgccgaccatcgccattaaatatgacaagctcagcaacattgatcaattcaaagagtttgcgaaaatgacaggcactgaagataaagcagacaaatggctggctgaatgggataagaaaaccgctgccgctaaaacaaaggttcaaaaagcggtcggctcaaaaaccatctccatcatgcagacaaacggaaaagacatctatgtattcggtaaagacttcggccgcggcggaagcatcatttatgacaaactcgggctgaaggccacaaaactgacgcaggaaaaagccattaatcaagggccgggctacgccagcatttcactcgagaaactgcctgacttcgcgggagactacatctttatggggccatggcaggccggcggtgacgacaaaggcgtgcttgacagctcaatctggaagaacctcgatgccgtcaaacaaaaccatgtctaccgcattgatccgatcggcttctatttctcagacccgatctcacttgaaggccagctcgactacatcacaaaaagcttaacgaagtaaccccgaagccgctgtcacagcggctttttattacgcttaaaacttgacaaaaaaatttatttatgttataatttacatttttggattaacatgtataataagattctcccggccggagattgatgtaaataacggaggatctttatatgaaagaaaacaaggcgagtatgacttccctgctgtccgctttcggaagggcgtaccacagtaaatacgacaccccggtgatatttgatgattttatggcacaagatctgatttccgaaaaagagcattcggacatccgcgatcatctgattcaaggtatatcatttttcagtaaagacatggcacagaggcttcaaggccaaccggatgacatcttaaaatgggtgactcaagtacagctgtctcctacaccgttagcccgtgccgcatattgtgaagaagtgcttttgaatgaagtgaagctcggggccaaacagtatgttatccttggcgcggggctcgatactttctgtttcaggcatcctgagatgacaaacgtcttagacatatttgaaattgatcatcccgcttcacaggaagacaaaataaacagattgaaacatctgaatctcgacatttcccatcatcttcattttgtaccgatggacttcgccgcttcgctttctttcagccgtctgtatcaggaaggtttttcacgccaaaaaacctttttcagcctgctcggtgtgtcatactaccttacgaaagagcatctcgcccgcctgctcacacaattatttgccgaagtcccgccgggaagctctatcgtgtttgattatgcagatgagtcgctctttgaagaaagaggactgtcaaacagagtggaaaacatggtgaaaatggctgcagcaggcggagaaccgatgttatcgtgtttcagttataaagaaatcgaaaaaatattagaatcatcaggtctgcttatttatgaacatgtatctccggcggacgtcaatgaccgttttttcagcggacgcactgaccatttaaccgcatttgagaccattcattatatacacgccgtcaaaaagtaatccgctgttgcaaacaaaaaaagacatctcacagacgtgagatgtctttttgtcataccgatggtctgttgtttgcaaatttctttgagacgaaaggatataacagcaaaccgacgaaaaacagcccgataccgagaataaaggtcgttaaatcggccgttccggtaataatgacgtaaaaagaataaatgcaggcaaggatggcgatgataccgtctcttactcttgaaccctttatctcgtcatacgtttcacccgtaaaaatgagcttcaggctgtaaaacgctgacacgagatacggaatcagataagcgagcgtcgccgccgtcgttaaaaacgtaaacgcgtcactgatcgtccgggaaataaccgaaaagataaagatctgtgacattacgttcgttacgattaacgacacaaccgggcttccctgtttattcgtttttgcaaaagcagcgggaaagtctcctgatttcgccgcttgatacggaacttcagaaccgagaagaatccagccgagcatcgttccgaacagacacaaaattgccagaatcgccatgatgacgcttcccgcgctgccgacgatcgcgtacaatacgtcaacaaacggtttttccgagccgacaagcttaccatgcggaagcacgcccatcgtaatcaatgtcacgatgatatagatgccaagcgcgatcaataatccggtaatggtggcgcgtttcacgtcgcgctgcgaacgggcgcgcccggataaaatgactgccgattcaattccgacgaacgcccataatgttgaaatcgccgcattgtggatctgtccgccgattccctcaaccgtgtgaggacctgtttgaacaggaaaataaaaatgatcgaaaaacgacgtttgaaatacaaacaaacctgcaatgataaagaagataaatcctaatacttttgaaaacgtcgtgacgaaatttaatttactcgcaccgttaatgctggtgacgaggatcgtgtgagtgccccataataaaaccgtacatacggcaaacgtcagcagctggccgagcgtaaccgcctgaccgccgatcgaaaacatttcacgcttatccgttaaaatcgggaaaaatgatgttaaatatccggcaaggctcgtgatgatcgccacgttgctgatccagctcgccacccagtagccccacaccatcgtgaagcccgcagcattcccttttttccgatcgctgaacagcgcacgcgcatagctttgcggccccgccgtcagctcaggcttgcggatggataagtggccgaagaccagcgcgatcattaacacaccggctcccgttaaaagccatgccgatgtggcgccgaacgggctcgcgatttttgcgagcgtactcgggagcgaaaagatgcccgagcctaccatatttcctacgacaaacgccgttaataaccaaaaaccccattttttcgtctgttccattcctgtacctcctggttgttcattcgtacggaccagaccccgagaccatatttacacgcaaaaaaagcctgaacaaaagtccatgcttaaagaaacacacacacccttgatctccggatagccctccgcgaaaaagcacgcggcagtcctgcacttattcagatacagtcccagcataaagaaggatcggctttctttacacttcggcgctgatgcctttaacacatgttttgcggccccttatcagcctggcatgtgcgactcatcatcaagcgcaacctctacctcaccgagaaagagtgaggatttttatcattcaattctactcagaggttatcagagataaaaagatctgtcaaagggaaatattagatggaaaacggatagagcgttcgccctacccgtcttatatggtcagcggttgtttttttcttttgaacagcttcttgaagcggatcgtctttcagagctgcactggcgtcgtcaagcgcgccttgaatgacgtttttgtttttatcgctgttttttcctttttctttgttaaagaaagccatctgtatcacctctttatcaaatataggtacacctataatgtgtctttttccgcggcagaatatgcggaatccgcgtctccttccttttggcggaacaggtaaagtttgttgatcaaacatgcattctcttgatatatttgtaattcaggggattttggcaaaaataaaaaggagaagcgaaaaatgacaggaaaaacacacatcatgggaggcatcgcttcttgttccgcaattgcgtattattacgggtatgatccggtccttatgacctcagcgggtgccctcggggcgctgattcccgacatatgccatacgaaaagcaaaatcggcaggacgctgcccgttctgtccaaagtcgtaagcacggtgttcgggcacagaacgtttacacacagcctgctgtttatgcttattatgtttttcattacggcaacctatattccgaatccgagcatttccgccggactgatgatcggaatggcaagccatcttgtacttgacgcatggaccgtcaacggcattaaactgctgtttccgtccgccatccgcttccgtcttcccctttatatgagaacggggagcttttcggagcagcttgtgctggccggcttaacgattgtatcctgctattatttatacgaactggttcacggccgcatctcttaaacaaaaagcgtcttttcgcttttagggtgaggagtcatacatatgaagaaaacctttttcagcaatcatcggtttttatgcctgtccatcctgttcatgtggatgaaaacctatgccgtgtataagctcggtttcggtctgcagaacaattcggttcttgaggaatgtctgctccttattaatccgctgagcttcattgtgccgctgttcggcatcgccctcttgctgacggaaaaaaaacagcggatctttctgctttcggcaaatgtgatgctgacgggaattttaatcgcgaatacggtgttttacgggttttatattgattttatcaccataccggttttgtttcaggcaagcaatatgggtgatatgggaagcagcgtccaagagctgtttcacccgctttatatcgctttatttttggatattgcgattttgttttatcttggaaaaaggcataaagccgataaaggaaaagcgggcgcccgtaccgttaaagcgtatgcgtgggcatcagccggcctcatgctgtgcaaccttgcgctgtctgaggccgagcagccgaagctgttcaagcacccttttgatcgtgaagcgctcgtaaaaggaatcggcctgttccactttcatttgtatgacaccatttcgcagacgctgaatgcaggggctaaagcgtttgccgatgaagacagccttgcggcggtcgcgaattacactcaagccggctacagcaggccgtccgattcaaaattcgggcttgcaaaggggcgcaatgtgatctttgttacgctcgaatcaacacagcgttttgtaatggatgagcgggtcagcggacgggagattaccccgtttttaaacaaactgcgaaaaaaaagttatgacttcactcatttttatcagcagactgaacagggaaaaacatcagattcagaattcattactgcgaattcgctgtatccgtcttcaagcggcgccgtttttttcacaaaaagcggccaccggttcaatacgatgtaccatatgttaaaagaccgtcaatactattcagccgttctgcatgccaatcataaagccttttggaaccgggatgagatgtacggggcattcggaatcgaccgttttttcgacgcggatgaatttaaggtgacacaggaaaattcaacaggctggggcctgaaggataaggagtttctcgaacagtcagcggaaaaattaaagaagcttccgcagccgttttacgcaagcctgctgactttgaccaaccatttcccttttgaaattgatcaacaggatcagctcattgaggaaccggacacaagcagcgagttattaaaccgctatgtgacgacggtccgctatgaagatgaggctctgaaacactttttcaagaagctgaaaaaagaagggctgtatgacaacgcgatgatcgtcctgatgggagatcattacggtatatccgaagcccataatcaaggacttgccgaattcttagggaaagaggaaatcactccgtttgatacggttcagcttcagcgcgtgccgtttatcattcatattcccggggtgaccgaccgtgcgccggaaacgattgcttcggccgcgggacaggttgatgtaaggccgacgctgcttcacctgctcggcattgaaacgaaaggcagcattcagttcggcaatgatctgttttccggagagcggactccgtttgcggtgctgagaaacggcagctttatcacggatgaccatatttatacgaaaaatacgtgttacagccgtaaaacgggtgaaccgctttctgacatgagcgcgtgcagcgatgagaaagaaaaagcggaacaagagctgatgctttccgataaaatattaaacggcgacctgctgcggttttataagcaataaaaaaatccctccgttatatggagggatttttcatgtttcatatatgagccgtcctgtcattttcgtatcatatccggataattgagaaagctgagacttgaattcctcagaattaagaatgtcccgcacgctttgaacaagctcccggttttgttttaagacgaccacatcgtactgctcactgatcaccgggataaagtccgtgcctgccatatgcgccgcatgcagcgacccgactccgatatccgcctttccgcttgatacttgtgaagccgctgacagatgatccgtgacaatgtcatgatatccggcgacatcagacggcgtgatgccgaatgatctgagctgttcatccagcagcaccctcgcgcctgatcctttttcgcgattgacgatgcggacatcctttcggctcatgtcctgaaagccctgaatgttcagcggattgccctttttcacatataatccggcctgccgcagcacgacatgaaaaagcgcaaacggctcccctgaaagaatgcgcttcacatacgggatgttatactgccccgtctccccatcgtataaatgcagactgacgatgtcacaagccccgcggtacatctcgatcaggctgttcaaactgccgctgtacttgcggagcggagccgcctgtattgtttgttccagctgtttgctgaggaggtccatcgacacatcctgcccgctgatgataacagactgccttttttccggctcccgcccgcgtgacgggtcaggcgcttctgctgcggatggcttttttgacattctcatgtttgctttatattgttttaagtcctcttcatcgaccctcatctgtcttccgaccctgtacgccggaatgagtcctttttttatcaaatcatatactgtcagtttggagaccttcaaaaggcccgcaacttcttctattgtataggaagtggcttctgtcatattatcacgctccgtttttattataactgttcagatattgaaaaaaaaccgcaccatcacgtacaattgcgttataattagtttgatctaatgatatttagctataaggggtgcacaatgttgaaaaagaaagcgacactactcacaactgcggctatggccgttttcctcgcaactgcgggctgctcatccggacaatcgtccaaaggcggacaaaacgaaaacgtcacgctgaccgtttctgcagcagccagcgctcaggatgcacttgaagaaatccagaccaactacgaaaaatcacattcaaacgtaaccattcaagacaacttcggatcatcaggcacattgcaaaaacaaatttcacaaggcgcgggagctgatttattcttctcggcagccgaagataaattcgaaaagctcgttcatgacggagatatcgacaaaaaggacagcacggatcttttgaaaaatgatctcgtcatgatcgtgcctgagaaaaacagcgcacacctgacacatctgaatgacctgaaaaaagacagcacggaaaaaatcgcgctcggcacgcctgaatccgttccggccggacaatacgccaaacagtcactgacggcattatccctgtgggacaaggtaaaagataaagccgtctatgcaaaagacgtccgccaggtgctttcttatgttgaaaccggaaatgtcgatgccgggcttgtctataaaacagacgcgctgatttcgaaaaaggtgaaaatcaccgatgaagcaccggcgaaaacgcacgatccgatcgtgtatcctgtcggcatcgtcaaggatacaaagcaccgtaaagaagcagaagcgttttatcagtatctgcagtcagatgaagcgatgaaagtgtttaagaaatatggatttactgccaagtaacattacggcttcggagtttttcactcccgtcgtactgtcatttgaggtggctttggcgtcgggcatcgccgtcatcattctcggaacgcttgccggcgcctggatggcgaaagcgcgatttcccggaaaaacggctgtggagaccctgtttatgctcccgctcgttcttccgcctaccgttgtcggcttcattctcattatcattttcgggaaacacagctttatcggccgggcgattgagcggatttttcaccagcccgtcattttcacgtggtcggccgcggtgatcgcttcggccattgtcgccttcccgcttatgtatcagtccgctaaaaccggcttcgccgcggttgatgctgacatcgagggagcggcgaaagtagacggagccggcaggtggcaggtgttcacccgtatttccgtcccgcttgcctttccctccctcttgaccggaagcattctcagtattgcaagggcgctaggtgaattcggggcgactttaatgtttgcgggaaatattcccggcgtcacccaaacgctgccgacggcgatttacgtcgcgatggactccggcaatgaaacactcgcctgggtgtgggtgatctgtattgtgatcatttcttttctgatgctgtttttcatccaattgaaaaagcccgcttgaccgatctgccttccgcgcacctttcgccgggaggctttttgatttaaaatcggatggtatataatgaaacaaaaacacacaaagggtgcggctatgaagattaatgtcattatcgcggatgataattctttcatcagagaaggaatgaaaatcattttgcatacatatgaggaatttactgtatcagcaacgttggaaaacggactcgaggcggcagagtattgtaagcacaaccccgtcgatatcgccttgctggacgtccgcatgccggtgatgaacggcgtcgaagccgcaaaacggatcgctgaggaaacggatacgaagccgatgatcctgacgacatttgacgacgatgagtatattttagaagcaattaaaaacggcgcgaaaggatatttattaaaaaacaccgaaccggaacggatccgcgatgcgatcaaaagcgttttcaacgggcacagcattcttcaggacaccgtgctggacaaaataaaagacagccttttccggccggcggaagccgcgcatcagattgatgaaagccagtttactgaaagagagctcagcatcatgtcgcttattgcgaaaggattctcgaacagggaaatttcaaaacagcttttcatttctgaagggacgacggccaattatatttcatctattttagggaaaacggggcttgagcacagaacgcagatcgccattttttatatcaccgggaaggtggataacgggcgttgaacggtatggatttttggatgctgatgagcagactgatcgctattttttatacggcttttttgttcgtatcggtagaccgcccttacacgccgtacgccgtcttatttctgctgctttatctgtctttgggcatcgcggtctgcatgatcaggccgcccgcttggaggcgcgggatcaccctcatgacgctggcattgaccgcttggctttccgccttaggccatccggcgtttctgtttcttttgccgcccgccatttttgcggttcttgccgaatatccggttcaccgctatgtgttctgcctgctcgtgtttttgccgtttttatttatcccgtacggcgaccttccgacttatatcgtcataaccttgttctgtctggcgattttcgttttggccgcccggtccggcaatcggctgaagaaatatgaagaacagtcggacagcatgcgctcaagcattgaaaaactgacgaaacagctgcacagcagcacagaatatatcaaacaatcggagtacaccggcaaactcgaggaaagaaacagattgtcccaagccatccatgacaaaatcggccattcgatgaccggcgcgctcattcagatggaagcggcgaagcggatgctcggctcccatccggacaaagcggctgaactgctccaaaacgccattaccatttccaaagagggcatagaggatatccgcataacgctgaaaaatatgaaaccgcccgctgaacaaatgggcattcacagattaagaacgtttattgatgaattttcggccaaaaacgggatgccggttccgtttacgcatcaaggcgatttggacaggctgacgcaaatgcattggagagtcattcaggaaaacgtaaccgaagctttaaccaatgcgatgaaatacgccgatgccacgcagattttcattgatatccatgtgctgaataaagccgtgaaagcggaagtgaaagataacggaaacggcgccgtccgctttaaaaaaggcctcggcatgctcggtatggaagaacgggcggccgtcctgcacggaaccgttatttttgacggcacggccggtttttccgtcacgacattgcttccggttgaataagtgaatgttttcatgtgaaaaatatgaagattctcatgtcaaaggaatgaacagctgcactaacggccgttcattcttttttttataataagagcatcataagacatagaggtggaaacatgaacattttggagctcaaacagctgagtaagaaattcggtgattatgccgccgttgaccagatgtcgcttgccgtaaaagaaggtgagattttcgggtttctcggcgcaaacggagccggaaaaagcacgacgatcaatatgatctcaggtcttttaaaaccttcaggcggagacattctgtttctcggaaaagatattttcaaatatagcaaagcaacgaaaatgaatatcggcatcgtccctcaggacctcgcgatttacgaggaattaaacgcctatgaaaatgtgaagttcttcgcaggtctgtacggcctgagaggggcggctctgaaagaacgggtcgaggaagccctgacattcgtcggcttgagcgataaacacaaatatttgccgaagcatttttccgggggaatgaaacgccggcttaatatcgcctgcgcccttgcccaccggccgaaactgatcatcatggatgaaccgacggtcggcattgatccgcaatcaagaaattatattctgcaatcagtgaaaaagctcaatgaaatgggctgcacgatcatttacacgagccactacatggaggaagtggaagaaatatgcacacgcatcgccatcatcgaccacggaaaagtcatcgccgaaggcacaaaagaacagctgacctccatcattaccgacacgaaggacgtcgtgattgagctgtcatccggaaacggcatcagcctcggcgatattcaggagctgcccggcgtcagagccgccgcactggaagaaaacagcgtgaaaatcagctctgacacaggggtcaacaatttaaaccgcctgatccggtacttcatggacaaaggcattgaaatccgctccttgcaggaacaggcacctgacttagaaacggtatttctcacgctgacaggcagaagtctgcgcgactgaccctattgaaaggaggattgcaaatgaatattctgcacatcgccgggaaagaaatcaaaatcagtttccgcgacagacggacttttattttcatgcttgcttttccgatcgtcttcatgctgatttttaccgcggcattatcaaacgcctttgattcagaggtgacggtcgggaacatcaaggtcgtatatacggaccaatcaaacgggacactttctcattactttactgagtttatgaaaaacgccaaaaaagagcatgtctattttcaaaaagcggacacggaggcaaaaggcaaaaacgaggttcgtgaaaatcaggcggatgctttcgtcactgtaaaaaacaccggttttcaagtctatacaaatgaccggagcggcatcaacggcacgatcgtccaaggcatgctgaccgcttttaccaatcaatacaaagcaggcgccgccgcttacaaggcgcataagccaccttccgccggacaaatcaaaagcgattatatgaagcagacgtctttacacaaagcaaaagaaccgaaggcgaaagatttttacgcgatatccatgacgacgatgatcgggctgtacgcctcgatttttgcaagctccttattccgcggggaaagaatacggcacaccgcggatcgcctgatcgccgccccgctccggaaaagcgatatctttcttggaaagatgctcggcattttggctgtgaatgttctgacgattcttgccgttgtcgccttcagcaaatttatcttgaaagcgaactggggcagccacatgggacttgtgctgttgattctcgtttctgaaattcttttggccgtcagcttcgggctcagcctgagctatttgaccagaaaacccgaaagcgccagattaatcaccgtcatcatcgtgcaggtgatgtccattatcggcggcgcctattacaaatatgaaggagggggatttccgccctgtcgcccttatcctggatcaataaggcgattaacaacatcatttacgcaaatgatgtatcagcggcatggcctgcactcggtttaaatacagcattggcggcactctttttgctgatcgccgcatttacgtttcaaagacgggagggactgtaatatgaaaaacttctggtggctgtttgcacacactctcaaaggaattacaaaaagcaaaaaacagctcattctttatatcggggctccgctgatcggcgtcttcctctccttcatgaccaatgccaacggcggagccgaaacgctcaatatcggcattctcgatcaggacggcggagaagtggcacaggatacggtcacgtttttaaaaggactggatcatgtgaagatttcggaggaaacggatgcgtccgcctcatcaaagatcgcttcaggaaaaatggaggcgctcattacgtttgaaaaaggcttctcccaaagcgtaaaagacgggaaaccgtctcacatcggcatgacctcgctgaagggcgcccaggtcaccggatatgtcagctcttatttgtacaattatatgaacagcgccgcctcaatcggcaaatcttccggcggagacgagaaagcctttcaggcgatgtacgccgatttcaagcattctccgattcaaacggagtccgctgttttgaaagatacttcgaaccataaagaaatgacttactcagtcatcgggtatctcattatcattatgctctattccgccggcaacctgacggaactgatgattaaagagagagaaaacaggacgtactacaggcttctgtcaacgccgatcacgtcaaagcagtatgtattggcgaatgcggcagtgaatatcattatcatggccgtccaaattatattcgccgttctctttatgggcgccgcttttcatattcatccgtcattcccgctgtggcagctgttcgtcctgatgatgctgtttgcattaagcgcaatcgggatcgcctttattgccgtcggtttttccaacagcagctcttcggcatcggcgcttttgaacttgatcgttgtaccgacatgcttgctcgccggctgcttttttccgggcaatattatgccgaaaacagtgcagacaatcgccgaatttctgcctcagcgctgggtgcttgatacggtcgatcaattgcagcacggccgcacgctccaaagcctgacgctgaacatcatcattttgggagccttcgccgccgccctgttattaatagccgcatacaggttcagcgtaaaacgtcagacacagacatttatgtaaagaaaaacagccccgtaaagggctgttttttcttagaacagaagctcgtccggattcgggccgacacgctcgtctttgttcaatgcgctgatcttttccatttcttcctgtgacagttcgaaatcaaaaatatcggcattttctatgatgcggtgctctttaatcgatttcggaatggtaacgacttcgttctgaagatcccagcgcaaaatcacttgagcaaccgatttgttatgtttttccgcaatttgtgacagcacttcgttatcgaggagctgtccctgcatcaatggagaccacgcttccacttgaatgccctgcgctttgcagaaatctcttacttctttttgagtcaggcgcgggtggaattcaatctggttgaccatcggcttgatttcagcatctttcagcagttcttctaaatgatgcacttggaagttgctgacgccgatggcgcggattttgccgtccttgtacagcttttcaagagcgcgccatgtgtctttatatttatccttgcccggccagtgaatcaggtaaaggtcgaggtaatcgaggccgaggcgctcaaggcttttctcaaacgcgtcaagtgtcgtttcgtatccttgatcttcattccacacttttgacgtgatgaacagctcttctctggcaacgcccgcagctctgatgccttcgccgacaccctcttcatttttataaatagccgccgtatcaatgctgcggtagccgtttctgattgccgcttcgacggagtccgccgctacgcttccgttttccaccttgaagacgccaaggccgaaccacggcatttcaacgccattatgaagctttacagtatcttttaagctttttgccacgttgaaccatcctttctagtcattatgtaaacggttattattatctcacatttccgccgtaagaaaccaattatacgctcatcgttatcacaaaaaccatctttagtgcccaagcaccactgacgttattattttcctatttttcaaaaattacggttaatcaggtaactgtccgggtaaatcgctactgtagccaccacacaattgaaggaggaaatcatatgaaacgtatgcgtatcccgatgtccgttgcccttggcgccgctttgtctctgactcctctgtcctttgtatccgcaaaagaaaacccggcccctcaaaacatggctcagcaaacatcagatgtctcagcaaaagatgtcggattaaacattgacgttgacctgctcggcatcggcaattcgattgctgacgcgattaagtcggcgcaaaaccgtgacggcttcgtcaaaaacttaatggaatcttcattctacgcttccggacaaaaatataatgtcatggtgtttaatttaagccaggaatatgaagatcattttaacggcgttcagttttacggttccgccgtttatgacggcatcacgtacggcatttgggtgtttgaagacggaagcttcaccaacaaaggagatggcggctggatcaactgggccttcagaggctggtttgaccgcgacggcgatcacgtcgaattccatcgtccgtaatctaaaaaagtccggcgaacagatgccggactttttttattcatctccgtcaagcatggccgcttccacatcattgatgtattggcgaagctcatgcgacatgtcgcgggaaatttcccgctcttcgaataatgtttggatttcgttgcggatggcctgcacggcccgcagtttgatttcgagtttttgattttcaaaacggcgactcggactctgttcgtgatacgagtgccccagcctgaaaatcaagtgattgtaaaaggaaatgacggcaagcgtcacatctttattttcttcagtcatgtgttttttcaggctttcaatggccgcttttgccgttttaacccttgtggagcgaatgaggccttcttcatttaaaatcgacatttccggttttttatgttcgccgaaaaagatccagtacatcaggcgtttcagctttttcttagataagccgactttaaacgggttcgtataaagcacttccagttcatcaaaccgttcctgaaggctgtcagccgtttcttccggtatgtcgccccgctcaatcagccgcagcaattcttcctgttctgcctgaatcccttgggcgcggactttccgctcatcttttttcgtgcggtttttgacggtgaactgctgaaacctgagatttttcattttctcattgtattcggcaatgaccgcaaaagaagccgttttgtttgactcattcatattttctttaatggcggttaaggcagcctttatcagcttccgtctcgctgtcagcaatttgactttcttttctttcacattgtcttccggcttatctgtcaaaatcggcagaacgattgtcgccagcaccaatgtgcacaaaataacgcccgcggctaaaaagagaatcaaattccgttcaggaaacggtgagccgtcagagagcacgtaaggaatggaaaaggaacccgcaagcgtgaccgctcccctgacgcctgaaaccgaaatcagcagggtcgagcgcaggccgggtttataaatgctctgatccttgttaaaaaaccacttgccgttccaaaaaaacagcacccacaaaaacctgagaatcattaacgtcagcgtaatgacgataatgtacccgatgaccatcatattgttaaacgcggtatcattaaagatgacggaaaccacatccggtatttgcgcacctaaaataacgaaaacaagaccgttcagaatgaacaaaataatattccacgtacttgaagagacgatttgcagtttgaccatcgttgattcaagacggtcctgctccaccgcatgcgtgatgccgccggccacaaccgctaaaatgccggaaacgccgatttcttcagccgcgagatagatgacgaacggcgtcagaatttgaatcagcatatgcatcgtgacatcctgcatgccgaggcgccgcataaacagccggaaacggataatcaaaaaagaaatgacgacaccgctgagtaaaccgccggctgaaatcagaacgaaactgaacgcggcttgcgccagcgaaaatgcgcccgtcacggcagccgcaatcgcaaatttaaaagcgaccaggccggatgcgtcattcatcagcccttctccttcaaggagacgcagaatgccttttggcatcttcacacgccctgacagcgcgctgaccgcgacaacatcagtcggtgacagaatcgccgccagcccgaacgcggcggccagcggaatgctcggaatcatccaatgaatcgtgtaaccgccgacaatcaccgtggcaaacacaagcccgagcgcaagcagcagaatcggcgctcttaaattccaaagttccgcacgcggcgtccgttttccatcgttaaaaagcagcggcgcgataaacaaaacaaaaaacaattcagtattcagttcaaaatgaagcccctgcggaaatgacgccgcaatgataccgagcgccacctgaatcagaggcaccgggataaaggggacaaaccgatttacgatatttgagatcgcgataatggttaaaagtacgagtacgactaaaaatatgtccaaagctgacctccttcatctgctgcatcatatcattattgcctgttctctgcccttgtcaaaggccggagccgatgatcgggcagattcaatatattttccgcacgcaaccattctccttttattttacccgtttttatttaaaatttctcataacgcgctcacggcgaactttttttgccttcagctacattttttccggaaaaagaaaaagcctgttttctctgaaaacaggctttttcgcaagctgcgtcatctgtttcatgacgcggagcagcgtttatgctgcttagtaaaggatagagaacgcaccgccagtgtgtctctatccttggttttaagagctcatcttattcgtgaaaattcgtgccgtctgtcgtcgctttaatgatgccggcgcggatgacgaaatcgccgaagtgttcgccttcctcacgctctttcgcgtagcgcgggagaatggtgcgaagctcattcagaatttcctcttcaccgatattttcccggtacattttgctcaaacggctgccgtcaaacgccgctcctaaatacatattatattttccgggcgcctttccgataaatccgatttcgccgagtgcatggcgggcgcagccattcgggcacccggtcatacggatggtgatttcttcatcccggagcccgttttcgtcaacaatgtcttcaatcttatcaatcagcttcggcagataccgctcggcttcggccatggcgagcccgcatgtcggaagcgcgacgcaagccattgaactgcggcggagggcggaatgctgccagccgtctgtcagaccgtattgttcgattaatgcgctgatttgtttctttttctggctcgagacattgccgataatcaggttttgattagaggtgagacggaaatctcccgtatggactttggcgatttcacgcaatcccgtcatcagcttataattctcatagtccgtgacgcggccgccttcgatgaacatcgtaaagtgccatttcccttttacgcccttcacccatccgtaacggtcgccgttatggtcaaaatgataaggtttcgcttcatccagctgccagccgaggcggttttccagctcggcttttacgttttccagcccgagacggtcaacggtgtacttgaatctggcattctttctgacggaacggtttccgtaatcgcgctgaatcgtaatggttttttccgctacatcatacagctgctccggtttgcagaagccgatgacttttgaaagctgcggataagtggccgtatcgccgtgcgtcattcccataccgccgccgattgccacgttgaacccgataagacggccttcctccacgatggcaatgaagccgagatcttgagaaaagacatcgatatcattggacggaggcacggcgattccgattttgaatttcctcggcaaatacagcggcccgtacatcggttccgtttccgtgtcaggagttcccgccacacgttcctcatcaagccagatttcatgataggctctcgtgcgcggaagaaggtcatcgctcaatttcttcgaccattcgtatacttccgcatgaatttcagactggtgcggatttgaagcgcacatgacgtttcggttgacatctccgcaggccgcaatggtatcgagcagcgccgcattgattttctgaatcgtttttttcatgttccattttaaaattccgtgcatttggaacgtttcacgcgttgtcagcttcaatgtattgtttccgtatttttgcgccagttcatccatgacaagccattgttccggagttgacacgccgcctggcatccggacacgcagcatgaactgataagccggttcaagcttttgtttttgacgttcattacggagatcgcggtcatcctgcaagtagcttccgtgatgcttcatcagccggttgtcatcgtccgggatgccggctgaaatccggtcgagcatgacttctttcaatgtgccgcgcaaataatcgcttttttctttaatttcctcaacatcacttggagggccttccggcgcttttaaaatgttgttcaccatgctgaataagctcctttcaaaccaaaatcaatatacgtcacgctgatagcgttttttctgctgcatgtctgccaggaagctttccgctttttcacggctcatgccgccttcttcctgaatgatatcgagaagcgcctggtgcacgtcatgcgccatatgctgttcatcaccgcagatgtatacggcggctccctgctgcagccattcatacagctctttgctttgttctttcatgcggtgctgcacatatactttttcctccgaatcccgggaaaaagcgacgtccatttttgtaagaacaccgttttgcagccatttttgccattccgtctggtacagaaaatcagtgacaaagtgctgatccccgaaaaacagccatgttttcccttcagctccggtttcttcacgctcctgcataaaggaacggaacggtgcgatgcctgtccccggcccgaccataatgatcggtgtatccggattttccggcagcttgaagttttggttgtgctgaatgtaaatcggaagcgtatctcccggctggagtctttccgcacaaagaatgctgcagacgcctttgcgttctctgccgtgcgcgtcatatctgaccgctccgattgtcagatgcacctcttccggattcgcttctaaactgcttgcgatcgaatagagccgggccggcattttacgcaggatcgaaagaaagtcttccgcggaagcttcccacggaccgaaatcccggacgagatcaagcagatcacggccgttggtgtatgctttcagctgctcttcgtttccttcggccagaagttcactcagcttttgatcagccataaactgtgcggccttttgcaaaagcggctttgttaagacggtaatttcaaaatgagaagtaagcgcgtctttcagcggacggcgctctccttgtttattcaccgccacttcctgttccggattccatttcagctcattgatcagctcatcaacgagcgccggatcattttccggatagatgccgaggctgtctccgggctgatacgcgaggcccgacccttcaagcgaaagctcgagatgacgtgtttctttatttgaaccgcgtccgttcagattgatgttctcaagaacctccgcccgaaacgggttcgttctggaataaacggattcaccgagagcgggcgtctcggcaggcgcttcggctgtttgatttcccgctccttcgttcaaaccgccgatgaccgcttcaagccattccgaaaacggctcatcataatcaagatcgcaatcaacccgcggcgcaagctgggtgccgccgagctcttgaagacgctcgtcaaactctttgccggtctggcagaaaaattcatacgagctgtccccgagcgccaaaacggagtaacggagctcttcaagcttcggcgcgcgtctgccgtgaagaaagtcatgaaaggccagcgcgttatccggcggatcgccttctccgtgtgtgctcaccacgatcagtaaattgtttacttttttcagattattcggcttaaaatcgttcatcgacgcgacggtgacctggaatccccgttcctcaagcgtctttaccgtctgtttcgcaagaccttccgcatttcccgtttgcgatccgtataatacggtcacttctttcgagactgccgggctttcagcaggagcctgagcagcgggcgcggctgtttcaccggattcggaccgggccgcagccaaatagccgctcagccagattttctgtgattctgtcaaggtcggcagaaggcggttaaggagctctgcctgctcctgattaaacggactgttcatgacctgaagttgcaacgatatccacctcacaaggaattaaacgtaacgtacgttatttctataggaattgtcaaaataatattctaattgaaactttaccgaaagtttgtatgtaagtaaaatatataatcatgatgacaacgattaagattactaatgataaaaagccctttgcactcagcaaagggcttatacgaataagccggcgggcacttcttttataaaaggagagggttctcccggagacaatacggtcaaatgatgcatcgcccgcgtacaggccgtatataacagcttacggtcatgttcgctattgtactgggcagcagaggcgtcagcggcgatgacggcgtcaaactcaatgccttttgccaaataaacgggaatgacgcatacccctttttgaaaaggctggttttctttattgattaaacggacaccgctctcggcgctgaccgcctgaaacacttttttggcttccgcggccgttttgcagatgacggcgaccgtctcccagcctttttgtctgagctcccggattgtatccgccaattgttcccgccgcgcattttctgtatccgtccgcaaaacacgcggtttttccccgttccggttaaaaggctcaatgtcatcgccgtcagccagcagcgctttcgtaaattcaacaatctgccgcgtcgatctgtaagtccgcttcaggctgacatacttttctgcaccattgcgaaagcagccggcgagggaagaagggcccgtaatggtatgggcataaatcgactggctgacatcaccgagcaccgtcatctttgccgccgggaagatggtttgaatatacgtgagctgaaatggggaataatcctgcgcttcatcaatgaagacgtgcttcatttgtgtgttttttctttttccttctaacagatcctgcaaatacagatacggagcggcatcttcatacggaagcgaccgttctgcaaatgcgtttccggtcaaagcgccgatgctctcccaatgatcgggcttttcatcagctccccagtctgaaaacagccggagatacatccgttttatatcgagaaagccgagccgtctgacggcctgcttaatcggtttaaaggctttgccgacaataatggcgccaagcaggcgctgttcgcgctgatggtcgtcaaatgcaggttcatcatctgccgcctgcttcttgagtgtttgataaacctcagcatagtcttccttatcaagcagctcgctctcctgcaagacccattccttcttacgctcctttttttcgagagcgctgatttccgcgagaagccattccgccgtcagctccgctctgttcggaatcggcagctgctgatcaagcgaataaaaataggcttcaatccgctcttttgaaatcaggatgtctccccggaagctgatctgtttacatttcaggcccgagaccgaaagcgacccggcatagcggtcaatcatggcctgaaaagctgatgacgctttgtaagcaatggctgcgagccttacggaaagtgcgtccttattttgttcagtcaggcaatattcaagctgctcgtacgggctttcacaatcaaactttcgtccgagccggcggatgatatattcctgaaaggtggcctgctccatattctcttctcccaattccggcaatacggcggacacataactgttgaacaaaatgttcggggaaaacaatacaatctgacgggcatcaagcaccccgcgcccgcggtacagcaagtaagcggcccgctgaagcgccgcggatgttttcccgcttccggcggctccctgaacgatgagatatttgcttttttcatcccggatgatttcgttctgttctttttggatggttgacacgatgtttttcatatgctgtccggaatggccgctcagcacctcttgcagcatttcgtcaccaatcgtcatatccgtgttaaacatcgctttaagcgtcccgtttttaatgataaactgccgcttcagtgtgatgtctccctctatcgtttcttccggaacttcatagcgggcttttcccggggaatattgatagtaaagagatgagatgggcgcgcgccaatcataaatgagaaattgctcgttgttttcatccattaaagaagtcagcccgatataaatccgctcggaagaggactcccctttttccgtaaaatcgacacggccgaagtaaggagaggttttcagcttttggattttttgaagctgccggtattgaagccgatgcgtccgttcacgttctgaaagcatttccgcctgctgtttaatgcttaaaaatgtctcagccgcttcgtgggcatcatccatattcacggtgacatcatcccaaaacgtttttctcaggccgacaatatcctgcttcaatccgcccgatgaggcttcaagatgagtttgtttctgttccagttccttcatgacaaaattgattctttcctgctcttctttccactctttatcacgttttgccatcagcggcacctccgacatcaagctgacaagtccggctttcatcatacaaacatatatgcaacatattattcagcattatggtcaaataccctttttcttatcatatcgggcgtctttttttatcagaagccgttatgcaaaaaaaccgatttcgtttgtgaaatcggtttttttactgttctatatgataggaacgaatcggcaggcgccacctgaacacataactgcagatgcggcatgccacaagcacaagaaacagcacatacaaaccggcggcatccccggcccagccgaggcccacgattaaccctccgagcgcggcccagactgcataaatttccgccttgagcacaagcggctttctgcccgcgagcaaatcccgtatgatgccgcccccgctgccggtcaggaccgctgccgcaatcaccgcactgagcggatggcccattttcacggcatataaagcgccttggatggcaaacgccgaaagcccgatggcatcggataggttgccccatttactccaatgccttaacagcagcttcggaaacaaaaagacaatcgtaactgatgcgagagcgatttgaaaaaacgcgccttgctcccacaaggcggagaccggaacaccgatcagcaggtttcggatggctccgccgccgaacgccgttacaatccccaagatatacacgcctaaaatatcatactcctcttccatcgcaacaatcgctccgctgaccgcaaacgcaatgatgccgattacactaagcagctcccaggccattccatatgctcctttttatttgttaaattttctgacgaccattagattttataatcgctttctcttaaaatcaaccttatttttgaaagattctgattcctgatccgggacaacctcatccgcaacggctgaaagcaagaatattttcctattttatactttaatggaaggtttattggaagtttcattgaatactttctctaacaaaaagggggttatgagatgaaaatcagttcacttgtttttcctgttttattggccgccggattaattcccggcctgccgtcagccgaaagccatacgcattcgcacactcatgcggagccggcgaaaacggtgtatacggacccgcttccgaaagccgatcattttaaagatctgaaaggcccggtccaagttgaacagacggttgacacaaaaattctggatgagaacggcaagcaggccggcacgaaacgattcaatgccaatgtcagtcaggataaagcctcaactaaagccagcacgggctcccagaaggtcagagtgctggcggtggcggacgctgaataccgcgccaaatacagcgactggcaaacgcgaatcgtccagatcgtggagcaggcggatgtcgcttttaaccgtgatcacaacattgatttcgtcgtacaggccgtgcaggcttggaattcttccggctcaaacagttctcagattttatcgaatctccaaagcagcttcagaaatcaaaattatcattttgtcgtcggttttaccgcaaaatcgagttttgacgccggcggtatcgcgtatgtatataacggcaaaccgagcggcccggctttcagcgtgaaccttgatcaaggaacggccaacacggcgaaagcggcacagcacgagttttcccataacttcggacttcagcatgacgcccaaggcagcggcatccgctgcgtcatgaattatgattatgcctattccgtggatatttgggacagctcccataacagacagattgcgacaaacaaagcttggtacaaataatagaaaaagagccgctcccatggagcaggctctttattttgccgtgcgttccgttttgacaaaacacatgcagataataatgagaataaatgccgtcaatgccaagaaaggaatggtaatgaaaccgaaccagttaatatattcagatgagcaaggcacgccgtagacacacggcttgatgccgctgaaaccgggcaccttctgctcaaggtaatgcatggtcgatataaatgcgccgatgacggccatcggcagcacatattttttcacgcgcgtgtcaccctggaaggtggcgattcctaaaatcaggacaagcgggtacatgagaattctttgataccagcacagctcgcacggtatgaattttctgatctcgctgaaataaaggctgacgagcatggcagcaagagctatcacccaagaagcatataaaaacacgattctatttttcatttttcagctctttcttaatcgtttttgaaatctcatcatatttagagaagtcattaatcaccttgtcatttacataaatcgtcggtgtcgccgtaatgtttaatttatcattcaggtcagtgtcagctttcagctcttttgcgaaggtttctttatcaaggttttccttcagcttgtcaggatcaacctttttcgcggtgcttttgaccgttttttcaagcaatgcaggcgtgacccattcctgttcgcttgacggctgctcttcaaacagcttctcatggaaagtccagaatgatgccgggtcttccttccacacctcttctgaagcaagagccgccagacgcgagccgcttccgtggtacatgacgttcacaaatgaaaatttcacgtcgcctttatcgataaaatcttttttgattttcggaaagatatcgctgttaaatactttgcatgacggacatttgtaatctccgaattcaactaccgtaacaggcgcgctgtctttgccgagcacgggctgtcctttaatggaaggctgttcggcgactgtttcgcccgctttttccgtttggttgttaataattacgatggccgcaaataaaacgacaacgattaacgtcagaatcaccgcaaatttcgcagacgattgtttctttttcactcagacacctcattgtttttaaaataaaaaagaagcggatgccggatggcccgcttctctattttaccaagacaaccttgtttaagaaaaccctgaaaaacgaattatctttgacaattattccgctttcactctcatgacgcgcatcgcgttggcaacggcgatcagcgtgacgcctacatctgaaaagaccgcttcccacatggtggcgaatccgaatgcgccaagcaagagaaaaatgatttttacgcctaaagcaaatccgatgttctgccagacgatccggcgtgtgcggcgtgcaatccggatggcttcggctgcttttgacggctggtctgtcatcaggacgacatcggccgcttcgacggcggcatcagaaccgagagcccccatggcagctccgatgtcagctctggcaagcacaggcgtatcattaatcccatcgccgacaaacatcagtttttcattcggtgaaagcgccgcttcaagttcttcgacgcggtctaccttgtcacccggcaaaagctctgtgtacacgtcatcaataccgagctcgaggccgacagcttctccggtctgctttgaatcacccgtcagcatcactgtccgcttcacgccgagcgcttttaaattggcaatggcctgtttggcgtcctctttgatttcatcggcgatcacgattgcccccgcatactgctgatccacggcgacataaacgacggttccgttattttcagctgtgccggaagcgatttgttcttttgccagcagtttttgatttccggccaaaatcgttgatccgccggttttcacccgaatgccgtgtccgggtatttcttcatattcttcaatctcctcagccgcgagcggttgattgtaagcttcgcggatggaagaagcaatcggatgattggaatggacttctgcaagcgcggctgcatgaagcaggctgtcattcgtaaatcctgccgccggtttgatatcagtaacggcgaaattgcctttcgttaaggttcccgttttatcaaacacggcgtatgccacctgattgagcgcttctaaatagttgctgcctttcacgagcacccctgctttagacgcagccccgataccgccgaaaaacccgagcggaatggagacgacgagtgcgcacggacaagaaatcacaaggaaaatcagcgcgcggtacacccagtcggatagcgcggctgaaggcacgagaagcggcggtaaaaaggcgagaagcaccgcaacaatgacaacggccggtgtatagtacttggcaaacttcgtaataaagttttccgttttcgctttgcgtccggccgcattttcgaccagattcaatatttttgacacggcagagtcttcataccctttagaggtttcaatatgaagcacgccgttctgattcataaatccggccatcacctcttgccccggctccgcttttctcggcacggattcgcccgttaaagcggatgtatcaaccatcgaggaaccgctcagcacctttccgtccagcggaatccgttctccgggattcacgatgatgacctgtcccactttgacgtcctgcgggggaacggcagccatgccgttttccgttttcacattggcgtactcaggacggatgtccaataacgcgctgatcgattttctggatcggctgacggccgctccctgaaacaattcaccgatctggtagaacagcatgaccgcgacgccttccggatattgatgaatgataaatgcgccgattgtggcaagcgccatcagaaaatgctcatcaaatacctggccgcggacaatattttttcccgctctggctacgatatcgccgccgatgatcaaatatgaagcaaaaaagagcagaaactcaaggacggcgcccgtgtgcgcgaagtaagcgatgacggccaaaacggcgcccgccgccaatctcactaacatcagctgcagctttttgcggtattcatcctcaccgggtttgtcttcgtgcttcgaacgaacggtcacatgaggatcaatggactttacttttttcgcgacttcatctttcatccattgctcgtttttcccgccggctgagaccgtgatggtgcttgccgcaaaattgacagcacagccgtctatgccgtcaatggcttttacgccgttttctattttttttgcacagttgctgcaatcaagtccgtctaatacaaattcacctttggctgctttcattttcgactcaccctactttccgtaataggattcccataacatcaatacaggtaaacgaatttatatatatgagcatatactcatataagtgttttctctattatatgcaggctttgaataaagtgtcaataaaaaagacaaaaccggcatcagccgattttgtcttttttcaccttctgtaaacgcaaagcattaagcacgaccgataccgagctgaacgccatggcggcgcctgccacccacggagccagaaagccggctgccgcaatcggaatgccgatgctgttgtagcccaatgcccatcctaaattctgcttgatgtttctcatagtcagccggctcatgccgatggcgtcggcaatgccgttcaggtctccgcggatcagcgtaatgtccgccgcttccattgcgatatcggtgccggtgccgatggccattccgatatcggccacagccagcgccggagcatcattgatgccgtcaccgaccatcgccacgcgccggccttctttttgcagccgggaaatttccgccgccttttgttcgggaagcacttcggcgatcacgctgccgatgcccgcggcttttgcaatggcttccgcggtctttttgttgtcaccggtcatcatgatgacgtcaagccccatatcattcagacgtttcaccgcggccggagatgtttctttaatggtatcagcgactgcgataagccccgccgctttgccgtctgccgcaataagcatcaccgtttttccttccgcctccaagcgggccatttgcggaagcagcgcttcatgttcaatatgctctgattccatcagccgtcttgatccggctagaatcgttctgccgtcagcctctgcatagattccggaaccgatccgggcttgaaaccgggtgagtttcgggatggaaatcccccgtttttcggctcctgacacgatggcttctccgagcgggtgctctgatcccgtttcggcggccgccgccagccgcaggagttcctcttcgttcattccctctgccggtacggcatctgtcagaaccggtctgccgtttgtcaccgttcctgttttatccagtacgattgtcgtcagacgctgggtcttttctaaatgctcaccgcctttaaagagaatgccgaattcagctgcacggccggagcccgccataatgctcgtcggagtggcgagccccagtgcgcacggacaggcaatgacaagcacggcgatgaatttgccgatcgcttcagaaaactgtcccggcgccgcccatacataccaaatgagaaaagtcagcacggccagccccagcacaatcgggacgaaaatgccggaaatgtgatccgcgagccgctgaatgggggcttttgatccttgggcttcttccacaattttaataatgtgtgcaagcgcggtatctttcccgacattcaccgctctgattttgagaaagccgtttgcattgatcgtcgcccctgtgacggtgcttccgggagacttatcgacaggcatgctctctcccgtaatcatcgattcatcaatcgcggaatggccttcaatcacttcgccatcgacaggaacgcgttctccaggtttcacgtatacgatatcccccgtccggacctcgtcaatcggaatcacctgtactttgccgtcccgctcaaccgccgccgtcttcgcctgaagcttcattagctttttaatcgcttctgatgagcggccttttgctttcatctctaaaagctttccaagcaatatcaaagtcagcaaaatggcgctcgtttcataataaagcccctcagcatgtccgtctcgcccgagagacgcaatcgtcatgtacaggctgtatgcgtaagcggccgtcgttccgagcgcaacgagaacatccatattggcgcttttgtttctcagcgccttgtacgctcccgtataaaaaggccagccgatgacgagctgcaccggggtggcaagcgcaaattgcagccacggattcatcaggatatccggcatccagataaaagaagtaaaagaaaaatggctgaccatcgaccataaaagcggaaaggagagaacggcagaaaatatgagcctgatcagctgctttcgctgctctttctccttttgggataatccgccgtctccatcaaccgctttcttcccgtctaatcggtagccgagttttgccacggtctctttcagctctttcggcgtcacctctttcggattgtattcaacggtgactgtttccagggcgaaattcaccggtgcgctcacaacgccctctgttttgttcaggcgcttttcaatccggttggcgcaagcggcgcacgtcatgccttcaatctgaaaatcggctttttccgtcacgacgtgatagccgagtttttcaattttatcctttatggcgccagcttcgattttgtcaggctgataggaaatatttgagatctcaagcgcaagattgacggaagcgtcattgacgccgtccatccgtttcagccctttttcaattcttgaagcgcaggcggcgcatgtcatgccccccacttgaatggtcatttctttcggttcactcaatgtcctcatctctcttcataaaccccacgagggtataattatgataaaagaaaaccgcgcccgttcccgcagcgcgataaaccttatacgacgtcatacccttgatcttcaattgcgtcttttatatctgatacggagactttgtgctcatcaaacgtcacatccacctgtccggcttccaatttcacctgaaccgccgtcactccgttcagttctcccactccggtctctactgcttttacgcagtgctgacaggacatgccttccacttgcagtgttttttgttccatgatgattccctccacgtcttgttttttcttttttatgttaccatacccctgtagggtatttcaaaacattttattttacgattttgcgatttttttcacaacatcaagcagctcggcaatcgcctgctccccgtttccgctctcaatggcgccggctacgcagtgatgggcgtgatcttccagcagatgaaacgcgactttctgcatggccgcctgcacggctgaaatctgcacgagaatatccacgcagtatcgttcgttctccaccatattctgaatgcccctgacttggccttcaatccgtttcagccggttcagaatctggtctttttccttggcgcttttatgatttaacgattgatgctcggtatgtttgtccattttccacctcggtttttttcttcgttatcttcattatacagacttgaaaatccggtgtaaaaaattttcaacacacaagttttaccagtacacccgcggggtatataatgttatcacatatcaagagggggaaattcattgaaaacgatacaggttggcatattgggatatggtttgtcgggtaaagtctttcatgcgccgcttttggacgtccttgatgattatcagatcaaaaaagtcatgacctccagaacggatgaggtcagacgtgatctgccgggggctgaagccgtgcgcgcgattgaagacattaccggtgatcctgacattgatctcgtcatcgttacgacaccgagcggaatgcattatgaatcagcgatgaaatgtctcctggcgggaaaacacaccgtcgtggaaaaaccgatgacggcgacttcagcagaagcggaggaactgagaagaacggctgaagataaaggcgtcttactgagcgtgtaccacaaccggcgctgggacaatgactttttaacgatacaaaagctgattcgggacggggcgcttcaagacattcatacatatcaagtcaactacgatctgtacaatccggttgtccaagaaagatggcgcgaaaaaagcggacccgccacgggaacgctgtatgatctcggttcacatattattgaccagacactcctgcttttcggaatgccggaatccgtcacggcacatgtgatgaaacagcgggacaacagtgaaaccgtcgattattttctggccgcgctccattacggcaaacttcaggtcattcttcaatccggctctatgaatgcggcaaacggcccgcgctatcagattcacggacggaatgcaagctttatcaaatacggaaaggacggacaggaagaggcgctttcagccggccaaaagccgattgacgacagctggggcgccgatgaccctgacaacttcggagagctgacaatcgcagcggatgaaaaaaggcatacagaaacaatcccctctgagaacggctcttaccttacgtactacaaactgctggcggacagcatcttaaacggaaaacagcttcccgttacggcaaaagaaggcatcgatgtcatccgtgtcattgaagcggcgatgaaaagcagcgagcaaaaacggacgattgccctttaatataaaaaacctcccagccgtacggcggggaggttttttttaagatcagaatgattttccggcttctttcgcgcgggcaatcgcatcttctttaatttgctgtgctttattcggttcagcattatggccttcaacgattaaaccgtcaaaagaaggaacgccgaagaagttcatcatgatgccgatgtaacggtggcccatttccatgtcagccgccgggccttcagagtaatagcctccgcgcgcctgaatgtggagcgcttttttgtcagtcaacaggccgatcgggccttgctctgtatatttgaatgattttccggctacagccacagaatcaaggtacgctttcataacaggcgggaatgagaagttccaaagcggtgtgacgaatacgtatttgtcagctgacgcgaattgatcgctcagctcgttcagacggccgactttcgctttttcgttttcagaaagctcttcaaatcctgtgccggattgaagttttccccagccgctgaatacatccgcgtcgatatgaggaatgttctctttgtaaaggtcgatatgtacaacctcatcattcgggtttgattctttataagaatcgataaacgcttttcctgtcgccatgctgtaagatgtcttttcatcatgaggatgagcagtgatataaagtacttttgccattgtaaacagccctttcgttttcaaattacacacacatttattatgaaatatgaatgtttttttatactgatcagttctgtaataattatagttacaaaaaattcttttcgcaacaataatatctcgaaatcagtatattttttaaaaaaggctgtaatgacgggaatggcaagcagcagaaaaagcagaaacatttagtttctgctcaaaatcggatttggtttgcagatcggaatatccaacccgagattcccccgcaatgtatccgccggatagctttttcggtacagcccctttttctgaaggatcggtatgacttgatccacaaaggcttcaagcatgcccgggatgtcagagtgaatgataaacccgtccgccgcttcccgctgaaaccatgtttcaattaatgatgccacacgttccggtgtcccgataaagttcgttcgcggaaacgcggcttcgcgcgccacttgacgcagcgtaagattcctggctttagcctctcttttgatacggtctgtcgtgctttgaaacgcgtttttcccgacgtcgcccaaatcaggaaacggctcatccagcggaaaacggctcaaatcataatcgtcaaaaaatctggccacatatttaatggcgttctctatcggtatcagctcggcgaattcctgatatttcgcttccgcttcttcttgtgaaccggctataatcggactgattcccggaaagatccgcagcttggaagcgtcgcggccgtaatccgccgcccgcttcttcacatcatcataaaaagctttcgtttcctcaagtgaattggagtgcgtaaagactgcatcggcattacgcgcggcaaacgaccggccggtttctgaagaccccgcttggaaaacgaccggctctccctgtttggaccggccgatattcagcgggccctccacttgaaaatactcgcctttatgatataggcgatgcagtttgtcaggatcaaaaaactgcccggtttctttgttgcggacgaaggcatcttcttcccaggaattccacagaccgcgcaccacgtccacatgttcttgagcgatgtcgtagcgccggctgtggtcgggaagactttctttgctgtgattgcgcgcggctcccgcctgcggagaggtgacgagattccagcccgcccggccgccgctgatatggtcaagagacatcagctgtcttgcgatggtaaacggctcagtgaacgaggtggaaaatgtgccgattaaaccaagatgggttgtagaggcggcaagcgccgataaaatagtgatcggctcaaaccgatttaagaaatgcgggatggacttttcagaaatgaacaagccgtccgcaataaaagcaaagctgaacagccctctttcagcagtctgcgctttttgcctgtaaaacgccgcattcgtgcttgctgtcggatcggcgtcgggatgacgccagccgtccgttgtgccgccgacaccgtgaatcatggctccgaattgaattagatccgtccggctcattttctctccccctttttcccctcgtaatcggcaagcgcccgttctacatgatcaatgccgacttgagtaacggcctgatacacacggctgtcaccgctgccgatttcaacgacggggacatgacggatgccgtacttcgtctgcagcacgtcacgcaattcgtcccgttctgtcacatcaattgtttcgtatgcaacggctttttcccgcaaatatcctttcacttcatcgcaataggagcagccctgtttgctccagaccactacgtttacttcatgactcatgttcatccctcctataattgtggggccggctgcaccgcttcgcttaacagccggtaagacaatcgtttttcctcagcgtttttgataggcgacaaaatcacaaaatcggtaatgctgtattgaacggataatcgtctcagctcggcggcggtctcttcttttgtcccggcaatcacacccgtcttttgtgtgatcagcttatatggctgcgtgacttgttccagaaacgcttccgcttgttcccgggaaccgacattcacctttttgccgtcttcgagaatgattttgaccgactcacgcgatacgacgtgtttttccgcttctgcttttgtatgcgcggtaaataccatcggcgcaaggtgaaattccgccttcgatcctttcggcagatgctcgtcaaaggcgtggcgcgctttttctaacgcagcctcttcaccgtttatgaaataggcgaaaacgaaggaaatgccgagtttggccgcggatatcgcgctttccgcgctgctgccgagcaaaaagatgtcaggcgcatactcagtatgcggcgtcggccgcaatgacgcgtagcggtgcgagtccggaaaatcatttcgaatgaaatgagtcagctcctcaagcttttcttcaaacaaacgggcgggctggataagctcccgctgcagcgcatcggttgacagctgaaatccgccgggcgctttgccgacaccgagcgccacacggccgggagcaagggcggacagaacccggaactgctccgccactttataaggactgtaatgctgcagcatcaccccgcctgatgcgagacggatttttttcgtgcttgcggcaagataccccagaacaatttccggcgctgatcccgctatctcttcattgttatgatgctccgccgcccagaaacggtcatatccgtattgttcggcctcctgagccaatttcaccgtttgccgcaaggcttcttctgcggtttggttttccgcggtgacactttgatctaaaatgcttaaacgaatcatacgacaggctcctttatgcgctcttttatgtcataaccgtaatcaggcagcacgcggcggaggaacttcttcgttctttcttttttcgtcttgtgaaaaacttcctcaggcgttccttgttccacgattgctccttcatccataaacacaattcggtcggacactcttctggcgaattccatctcatgtgtgacaatgatcatggtagcgccggtccgcacaatgttaagcatcacctcaagcacctcgccgacaagctccggatcgagggcggcggtcggttcatcaaacagcatcacatcaggatgaatggcaagcgcccgggcaatcccgacccgttgcttttgtcctcccgacagttgattcggataggcgtgtagtttatcctgaagccccaccttggccagttcccgctcggcaatggcgtacgcgtctgtttttttcattttccttgcgaccgtcaggccttccatgacattttgaatcgccgttttatgcgaaaacaaatgatattgctgaaaaaccatcgctgtctgtttcctcagtctgagaatgtcttttttggcaggctttttgcagttaatgacttcaccgtgcagcgaaatggcgccctcatccggccgctcaagcaaattaaggcagcgcagaaaagtggttttcccggaaccgctcgggccgatgatggtcacgacttctcctttccggacacttaaattgatcccctttagcacgtgatgactgccaaaatatttctgaatgtttcggatttcgatcataatgcgcctccttgatatctggccgctcttttttccgccagactgtttacagcttcgagaatcagcgttaatccccaataaatcacggccgccccgataaatgcttccagaaacgcatagttatcggatgccgcaatcgtcgccgttcctgtaatttcaggcactgcaacaattgccgcgatggaagtggtatgcaaaaagccgatgcctatattggtgaagttcggcagcgatatcatgaacgcctgcggcagaattacgcgccgaatcaactggccccgcgtcagaccgattgaatatgccgcctccgcctgccccgtatcgacggccatgatcccggatcggagaatttccgtcatataagcgcctgccgttaatgacagtgccatgatgacaaacacggcgaccggaatctgattggctgaccagccgagatgaaacgcgcggctgaattgatcggcaatcagcggaacccctaaataaatcagcataatatggagaatcgccggggtgctgcggaaaaaagacacgtaaaacgctgagcaggccagcagccatttgatgcggaatatacgcaccgtgatattgccgagagctatgaaaaatccggcaataatcggaatgatcgtcatcgccaatgtaagcggaacggttttcaacatttgttttatcgcagtgccgataaacggaatgtccagctccactgttctccctccttttcagccgtgcgcactcatgtcaaaaaccgtcacaaggcgcgtctcatctttcttgattcgtttttcggcccatctgaagacacattcaaataaaagggcggccgcgtaatacagaacagacagcgagatatacacttcaagagaatgattgctcgatgtaatcaaggtctgtcctctgcccgacatatccatcaccccgatcgaaaaagcgagtgatgtatcttttaagaaaccgatcaccatattcccgatgttgggaaaggcctgcacgagcgcctgcggcagaatgatgcgccggaatgtctgccctctgttcagcccgatgctgaacgccgcctccgcctgcccgcggccgacgctgttcacacctcccctgatgatttcggccgctcttgccgcgctgctcagcgcatacgtggcgatggccgcatacaaagggtccattttagaggtatcaattccggcgagcgccgtgagcgccggaatgccgtaaaatacaatgaacagctgcaccatgataggcgttcctctgaaaaaagagatatacagcttcgcaaactgattcaaaacgggaatgcgatagatgcggggcagcgccaaaagcagccccaatagaaagccgaacagcaaagacaccgccaatatatacagcgtgacgggcaaatacccgagcaatgtcggcacaaaggacgcgatcatactgatatcaaacgctttttccattgccggtccctctctttttcacttaatattgctcccttgaataatccgcgccgagccacttttcactcagctttttaagcgtgccgtcatcaatgatttccttgagcgctttatcaatgtcatcgctcagcgtttgttcatttttgttaaacataaagaacactttggcatttgacagcaccccgccgaccgttttttctttgatcgcgctcgttttgttttgaaaatcgacagcaaacggcgttgaaatcgttgcatcggcgcggccggatttcagctgattggccgcatcgtttgaaccttggccggcataggcgatttcaaaaggactgccgtgtttttcattccattttttcaggacaagcgcgccgtttgacgtcggacttgtaatgacccgctttcctttcaagttattaatgccgtgaatgtccccattatcttggagcaccgtgattttcagcgggaagttgttatacgcgacttgattgaacagaaattttttctcccgttcggcgcttttctccatttgatgagccacgatatcgactttatgctggccgaggctgacaagcaggttggagaaatccatcgttttaaaggtaaatcgatagtccggcaggcgcctgtcaagctctttcaccagctcaacgtcgtagcccgtcaatttgcctttatcatcaataaagcaaatattcgaaaattgagtccccgtgccgaccgtaatgttcttcacgtttttctgattgcctgatgccgcctcccctcccgcgccgcaggctgataacgccgccgttgccgcaattgttaatgacatgaccgccaatcttattttcatgtgatcgccccgttttctgcttcaattatttcgtgaaacttgattttgaataatccgcgccgagccatttttcactcagccttttcaatgtgccgtccctcacaagcctttgaatcgcccgatccgtatcgtccgccagggtttggctgtttttattgaacataaaatacacctcggtatcgagcagcacatcaccgaccgtcttttgtttgaacgcgtgcgtcttattttgaaaatcgacggcaaacggcgtggatacggtggcgtcagcgcgtcctgtctcaatttggttcgctgtatcattgccgccctgcccggcgtatttcaaatgtatcgggctgccgtgggttttgttgtatgccgtcatataatccgccgcgtttgacgtcgcgccgacgatgacggttttcccttttaaatcccggagcgtgcgtaccgcgtcattatccgccttcaccgtgatgtacatcggcgagtagttatacgggattttgtgatacaaaaagcgtttctcccgttccttgtttttcgccatattgtgcgcgatcacgtcaattttccggtttccgagacttgtaagcagattcgaaaaatccatcgtcttaaagacaaatttgtattgcggcagctgttcatcaatggctttcatcacttcaatgtcatagccggtcagctcgcctttttcatccataaaagcaatgttcggaaaatcagttcccgtgccgacgatgacggtctgcacgccgctccccgcttttgcgctttctccttgcccgcacccggccagcacgccgagcagcagaagcagacagccggctctgatccgttttttgatcattgcgcccagctcggtgtgcctaacagcgacgcgtcaaaccgctccggtatgagcacctttctcatcataactccgatgtctccgtctttctcctgctcaaaatacacttcatatcccctccgtctgtacatatctacaagccagggatgcttgcgcgccgaagtgccgagcgtgatggccggggccttcagcgtatcccgcagcacatgttcctccacataagtcaaaagtttgctgccgatgccctgccccttcagctcaggaagcgtcgcaaaccaccagacaaacggatattttgacggaggcgtgtcactctcccacggaaaacggatcgtaatggttgaaagaagccgtccatcccgttcgagcacgacggctgaatgattttcaatattttccgttaccatatcgatgtcggcccgcgccgacggccagtcaatctccaaattgcggatcggctgaaacgcgctgtacagcagctctaaaaactccggcgcatcctttttctcagccaatcgaaatatgtcttcactcattccggtcactctccccgcaaaaaatatataattccaatttgtttactaagctttgattgtttatactataaagcaaactgatttgtttgactaatcaaaaaaagtaaaggaaaggttcaagaaaattaatgaacagccgggaggggatttcgttggaactacgaaccattaaaacgtttcataccatcgtacagtcaggcagcttttataaggctgcagaaattctgaactactcacagccgacgatttcaatgcggattaaacagctggaacaggatgtaggcgcgcagctgtttgaacgtggaaagaagctgaagctgacaagggcggggcggctgtttcatgagcgggccgggcagcttctcgcgcaatacgaggtgcttgaccatactctggccgatatcagacagggccaggccggccttattcagatcggcatatccgaaccgacggcaagcctgatcttccctgccgtgctgcggggtttcttaaatgattatccggacatgtcggtcaatgtcagcgtggatgatgccaatacatgcagccgcaaactgctggagggcgctattgattttgcggtatgcggcgagccggagctgattctggaaaattatttcgatccgtttttccatgactcgctcaatgtcatcgtgtcagacagacatccccttgccgccaaagcaagcgttaatctcgaagatttagaaaatgaatgcctgatttttacgcccgccaattgcccgatccggattcaaattgaacagcacctgcagcgggccatcgggagccgctatcgaaaaatggagctgaccagcagcatggctcatcaatactatgtcagggaaaatatcggcgtctcaatctttacggcgacggcgcattcagagccgatcgagggcacgaaggtcattccgatccataacttaacaatttcaccgcctgtcgggcttttgacaaaccaaaaagaagagcactttgactgtgcaacaaaagatttaatcagcaggatcatcagccggtttcagcgtgatccgcattaaaaaaacccccgccactttgcgggggttttttatgttcatcttatataatgctccgcaccaagccgccgtcgatccgcaatgcagatccgttaatggcagacgacagcgggctgcttaaaaaggcgacaaagtgggcgatctcttccggacggatcaaccgctgaatgatggacgtcggacgattttccttcataaatcgtctctccgcttcagccgctgtcaagttttcaccgggataaagcgactcaagcattgtttcgacgccctctgttttcgtggagccgggcatgaccgtattcaccgtcacattcgtcccttccgtgagctcggccaggctgcgtgacagcgacagctgcgttgttttcgtagcgctgtaatgagccatttcctgagaaggcatgacggccgcttcactcgcgataaagatcacccgtccttccttccgctcaatcatccgctttgcataccggcgtgtcagccgcacgccgctcatgatattcacctcgaaaaaccggagccactcttcgtcaggaatatcaaagtattccgcaggttcaaagattcctaaattgttgacgagaatatccacatcaggatactgctgaaaaatcgcgccgcatccttccgccgtgcctaaatcaaacgcggccggatagagacgggcatccggcgtctgtttctctagttcccggatcgtttcgttcaccttttcttcacggcggccgttaatgatcacggccgcaccttctgcaatcagcgaagccgcaatcgccttcccgatgcctgacgtagatcccgtcacaagcgccgtcttccctttcaactgcaagtccatcatccattcctccctatcgcaagtctcttcttatatatggacagaaatcgaaagcctgaaaccttccgtccctattatcggatagaaaaatggatgaggggaagtacgcactttttagtgcctgtccgttgtcccggctgacggctgatcaatttgaatgaaaaattcaccatctaattctgcctgagcctcttgaaacagctccaagacatcatcagcatccgaacccaattccttctgactgatctcaaaattcttccacaccaaagtcagcggaagttcgatccagcctgtcagacaatcccataaggcgttcagattttcaccataaaagtccgggaaatctaattgatcttttaagattcggtgtaaagcttctgtgcttgtaacatcttttccgtctatgatgacgatttccatttacattcactcctttttgtcggcataaaaaaaccgcagtgcgtcatgtgacggcactgcggttcctctgttatgtatggagacggtgggagtcgaacccacgtccagaaacatcgattacttaagcgtctacgagcgtagcctgcatatttcgtgtttcactcgtcttcatgcctgcgggcgggccttccgagagctagtctgtcagtctcttcttacgttctcagacgggaacgcaagcgtagcctacttggatgtgctcttcacggacacataggcaatgtcaggaagagctcgctgcgtttattaggcagctagtgctaagttttggttaaaacttttagttttgccagttatatttaggtgcgtgttaacgagatcgcctctcggctcgcagctcaagctcgatccatccctgtcgaatccgtaacgtccccttgttaagggtatacgggagatctatcaagctcttgctcaactggctgtactgttattataccatgatcacaggcaaattcaattgggaatatcttcaataaacagcctgtgaatctgatgtgtgaacagtatagcacagggcatatcatcacatcaaggctcaggcatcagaagcctttttgtctgtctctgaacgctctttcgatttctcttttggcgtcttttcgttttaaatcttcacgtttatcgtatgttttcttcccttttccgaggccgattaatactttggcgaagccgtttttcaagtacagcttcagcggcacgagggaatagcctttctctttcgtcaggccgatcagcttattgatttctttccggtgcatcaaaagctttctcgtccggagcgggtcgtggttatagcggtttccctgctcgtacgggctgatgtgcatgttgtggaggaacacttcgccgcgctcgattttcgcaaaggaatccttcatgtttacgcggccggcgcggatggacttaatctccgttccctgcagcacgatgcctgtttcataggtttcttctataaagtaatcatggtttgcttttttgttttgcgataatactttgcctgatccttttggcatgccttatcctcctctctccgcaaaaaccgttcatgtgtgcgatacgctttattttagcaaatggagcgttccgcgacaatgaaaatgcggcttgcgaaagaaagcaaacagagcattatgccctatttgcttttcgcatttacttcttctttttgcgtttttgtttcggcgcgttttggaagccgcgttttttctttttcttcttcggttttgtaaaccattcccctttttcctccgatttcggcggtgaagccggggtattgctgtttaacacgcgtttccgcgccggtctgcctcgttttctgcggtcgcctgttgtttctctcggacggcgggtgcctttcatgccgacaatttcaaagtcgatgtttctctcatctttattgacgtcgacgactttgaccgtgatttcgtctccgatgcggtaaacgttgcccgtgcgttcaccgatcatggcgaaatgctgctcgtcaaaacggtaataatcatccgtcataaagctgacgtgcacaagcccttcaatcgtattcggcagctcgacgaacattccgaaattcgtgacggaactgatcatgccgtcaaattcctcgccgattttatcaagcatatattccgcttttttcagatcgtccgtttcccgctcggcatcaacggcgcgccgttccatcgttgacgtatggtcagcgatttccggaaggcgttcggcccacttttcctgagttgcttcgtccgattgtccgttgatcaaatacgttctgatcagcctgtgaacgattaagtcaggatatcggcggatcggcgatgtgaagtgcgtataaaattcagtcgccagcccgaaatggcccaggctttgcgggtcgtatttcgcctgcttcatggaacggagcatgaccgttgaaatcaccgtttcttccggacggtcccgcacttcatcaagaatgctttgcagcgcgcgcggatgaatgtctccggctttccccttgacgatataaccgaatgtcgtgacgaactccaagaacttttgcagtttttcggcgttcggctcttcgtgaatccggtaaataaacggcacgttcatccaatggaagtgctcggccaccgtttcgtttgcgacaagcatgaattcttcgatcagcttttccgctactgagcgctctctgatgacgacgtcttttacggcgccttcctcatcgacgagcaccttcgcctctttgaaatcaaaatccacggcgccgcggtccatccgtttcgcccggagaatttccgccagacgttccatgtctttaaacatcgggacgagcggctcatatctttctttcagctcggcgtcgtcttctgtaaggatccggttgacatctgaataggtcattctttccgtcgttttgatgacgctttggaagatctcgtgctccgtcacctgtccctgctggttgattgtcatttcgcaggaaagcgtcagccggtcgaccttcggatttaaagaacagattccgttagacagtctgtgcgggatcatcggaatgacccggtcaaccaagtacacgcttgtccctctttccagcgcttctttgtcaatcggggaattctccgtaacgtaatggctgacgtcggcaatatgaacgccgagcttgtagctgccgttatcaagctttgtcacggtgacggcgtcatccagatccttcgcatcggcgccgtcaatggtgacaatgacctgatcgcggagatcacggcggtctttgatgtctttttcatcgatggtatcgggcgtgcttgttgcctgctccatcgcttcagccggaaaatctcccggcaggccgtgcttatggatgatggataaaatatcgatgcccggatcatttttatggccgagtatttcaacgatttccccttcggcgttcattctgccttcaggatagcttgtcagtttgacgacgactttatggccttccgcagcgccgttattggcatgtttcggaataaaaatatcactcgtgattttcttatcatccgggatgacaaagccgaagcttttcgtttctgtgtatgtgcccacgacgcggtcgatgcttctttccaggatgcggatgaccgtgccttcctgtctcgatccgcttgactgggaattgagccgcaccatgacaatatcgccgttcatggccgtattcagctcgttcggcggaataaacacgtcgcttaaagaggtatcctccggcagcagaaacgcgaagcccttcgcatgcgcggaaatttttccttttactaaattcattttttccggaagcccgtagcggttgcttctggtgcggacgatctgtcccgtctcctcgagcgccaccagcgcttttaccagctctttaaattcatcggcttccgtgatgttcagcatctcctcgagttcctgaatggtaagggcttgtacgcctcttccttcataaacgcgagaagacggtccataaacgcttctttttccattattcgacctcctgtttgttaccaatcgagtttctctaaaaattcgtacacatcctgatgaacgaggtcccgttctttatcgagtgtaatgacatggcctgattcttcataccatttcagctgtttgtcgtccgtttccacctcgttgaaaatgatgttcgcactttctgtattaatcatatggtcatgccgtgcctgaaccacaaatgtcggggaatagatcatgtcgacgtttttgcgcacatcggcaatcagctcctggagcgatttgagcgtattcatcggcgttttttcaaactccttcatttccttttcaatctgctccggctgttttccttcgaattttttataattgcgcgcgtaggagagaactccttcgtacataacctcttcacttttaatgtgcatcggcgcacacataggaacaattccctttatgggtacagtgtaacccaatttcaatgaaaaaaccccgccaagcgacagtccgcacgccgcaatgttttcatagccttcagaccgtaaatactcataaccgtccatgacgtctttccaccaatcttcaggtcccgtatgtaccagctcttccggcggaacgccgtgccctttatattgaggcgcgtgacaagtgtagccgcgctcattcaagtagcggccgagcattctgacgtctgccgtatttcccgtaaatccgtgcagcagaagcaccgctttgtctccgcctttaaatgtaaatggttttggtgtcacaattttcatgctcataaccccttttttgcacattcaatttagttttccacagttttgcgagaaacaaacgccgtctctcaacaagaaaaaggcctgatattaaatcagaccttatacaaacattgccttatacgatatacgctagcgaaatcgtcaacacgaaaaacaagactgccagcacaacggttgtgcggtgaagaatcagatcaaggccccttgctttctgttttccgaaaagctgctccgccccgcctgaaattgcacccgataaaccggcgcttttgctggtttgaagcaatacgacaataataagtgcaatactgacgataaccaataaggtaatcaataatgtgtgcatcccatacacctccagactgactggcctacattgcttctattttacatgaaaaacaaaggcatgtcacgccgtatcggtgtacatcatgtcagaaaaacggaaatgcgtttgaatcttccatcttcattgacttttgtcaacaaagtcgtagtaaaaaagatcttcaaatttcatgtcaaagtaatagagcatttttccgatgaccagctggcccggccttcgctctccattcagtacacggctcagtgtggcgggagatattccgatctccagggcgagctggtttaacgagtagtcattattgaccatatactgcagcacataatctcttctgatctgtatcttttcgaccactttcttcaccttccgttctgtcaaatactttctttcttatacataagatacggcttttgttaacttttgtcaatacttttccagcctggctattccctttagtcaataaacatactagaatataaatagaccgcgggagggggagagactgtggaaagcttcgggaaacaattgcggacattacgggaaaaaaggcatctgacagtgaatcagctggcaacgtattcaggcgtcagcgccgcgggaatctcgcggattgaaaacggcaaacgcggagtgccgaaacctgcaaccattaaaaagctcgcagatgcgttaaaaatcccgtatgaggaactgatgcagacggcgggatacatagagaccgtccaggaaacgagagccccgtacgacacgggctgcaccttgctggaaaaagccgaaacgtatgagctgcatgatttatcccttttggagcgggagaactggcggcacctgtcgaaagaagacttggttctgcttgataaatactttgcgttcttatcggcggaagccaaaaaaagaacaaatgaagactcatgactttgcacatgtgaggcgatcttattgaacacattcggaaagcaattaagagagctgcgccgcgcccggaagcttaccgtcaatcagcttgccgtctattccggcgtcagctcggcgaccatttccagaattgaaaacgggcaccgcggcattcctaaacccgcgaccatcagaaaattggcggacacattaaaaatcccgtacgaggagttaatggcgcgggccggacacatcaaggcatttcaggaggaaatccgtgaaacctccgaaagctatcaatccatctgcgccatctatcagaccgccgttgacagaggcgcggagcatctgccgctgtttgacagcaaaaagtggcagcacttcacaaaagaagatattgaaagcgtcagcaaatactttgattttattgcggctgaagcgaaaaaacgctccccggattcctcatcctctttttgatcctctcctcaacttaacaagcgccagacgtacgttccctccgattttgcggtataatagcagaagacgaggtgaaaaagcatgaaccaatcagaaatgtgccccagattcgaaaaagcggtcgacatcctaagtaaacgctgggtggctctaatcgtctttcagttattgaacggacagcagcgatttagcgaaattgaagcggcgcttccgaatttaagcggaagagtcttgtcagaacgtctgaaagaacttgaaacagaaggtgtcatcaaacgggatgttatccccgaaacgcctgtccgcattgagtattctttaacggaaaaaggctgcgcattagcccctattttagaggaaatttccaagtggtcttcaacatggattgatccttcctgataaactcttttccgcataagcggctgatctctcaaacggacagccgtttttatttttgcttttcttatacagaaaaacaagccctcaggcgtgcagggcttgtttttgtctgacgccttccagcggaattcgaatctccgcccgggctcctccagactcctgattttcaagtattaattcgccgtgatgaagatgtacgacgtgatgggcgaatgtaagccccatgccgtgatgccccgccgaatgtctgcttttatcctccgtgtaaaaaagctgtgtcgctcttttcagcgcctccggcgagaacccgcttccgctgtcggatacggcaagatggagggcggaatcggtgcacaggacgtccacacggatttcccctccttccggcgtatagtcgacggcatttgccgcgatattcatgaccgccctgtggagcagctcatgatcgatcggcgcttctattcggtcaattccccgttcgctgaggacgagatccatctgcttcggccccgcaagcgccgccgcgtcacgatatatgttttgaatccactctttgaggtcggtatattcgacatgaacggcaactgcctcctctgctttggaaagctggatcagctgtccgacataatgctcgattttgtttccggcatccaggatatactgcgcatattccgcctgctcctcatcaggttctgttaactggagcagctcggcatttcctttaatgatcgttgccggaattttaatatcatgcgcaagcgcgccgatctgttctttctttatccgctccgcctcccactgcgccgccagagatgcctgaagcgcgtctttcattttcagcagagagtcaatgacatcgtcaaattcttttatacgcgacctttttggattgatatttaaattctgtttttgaatgcttgccgtaatggagctgagtgtgctgaaatgccgtctcagctgattggcgaaacgcgtcgtcacgataaaaacagtcaaaagaagcaaagtgatcagaatcgtaagacccgtccattcataattcggcagatagcgccttaacagcggcgactgaaattccgacctgagtgaatattggagaacgccgtattcatctttccgatttatcaccatgaatcctttttgagcataattaaaatacggcgtatgctgaatcttttttctggcgttggccgcatcttgttccgtcatcgttccttttgtcatccgctttgtttttttatcaaaaacggcgtatgtcatacctgcggggatcatgtcttctgttatcttttccgctgatttcaggcggggtttgatctgttccgcctcatgctcgctgtagtttgcgggcaggatcgctccggcattcatggcaatggcatttaaggcgacgcataatgccgccacccccatcgtgctcagacacaaagtgatggtaaatttgacaagctctttgcggatgctggattttccttttgctattcccatttgtatccgacaccccacaccgttttgatcggatcagccccgtgttctttacattttttccggatggttctgataaactccgtaatggttgaatagagcgcatcgccgtccaagccgtacacttcctcgtaaatctgctcccgtgagaatgttctgtttttatgctgtgccagaaattcaacgattttatattcgtttttcgtaagaggcagtttccggtcatccatccatacttctttattgtcaaaatcaaacatgaagcctgatatcagccgtttcgtctgatgcttttcccgccgttcccttctgacatgcgcgtttacccttgccatcaattcctgtacgccgaacggctttgtgatgtaatcatcagcgcctgtcatgaggcctttcacaatggattcttcgtcagactttgccgttaaaaacaggatcgggctgtccaccagcggccgaatccgccggcagagttcaatcccgtccgttccgggcatcatgacatcaagaagaatcaaatcatagccttgaaaaaaatccaatgactgatcttccgctttttccagaatcgttactgtatgctgatcacgctgtaaaatgtttctgatcagaacgagaatatctttttcatcatcaattgctaaaatgtttgccaccggccgaatcgctccttgcctttattcatatgaacgccgcccttcccatcttctgcaccaatagaggccggccagacataatatcactatagaaaaatataacattatttctccgaatctcatatcgtatcttacataagggaggaactcttttttgactttgtcaaaatgcagcagtcctgcaaggcctgaaagcctcacgctccatgcccacggaaaaaaacgccagatgatatcgccaagtcccgtattcatgagcgccgccattaataatcccgcaccccctaaaagcccggacggtcccatgccgtactttatgccgacaaaaaaagacatcatataaagcggaatactgccggcaatcagccacgcccctccttttaaaaagagaagatacgggagatcattgatgtgaagaacaaatttcaaccccgccaaataaagacagatggcgagaccaaccgataacacattcaataggagcagcagaagcagcttgcccgcaaaactgacgattttagaatacggaaccgccagcatcatctgaaaatggcccgcctgttcctcgacagaggcagacatgccgcagacaatactgatgatcagagggtataaaacggcaatcgcgctgaaaaagacgctgtacagcatataagactcctgaacccttccatacatatataacaggaaaaatcccgcgcataaaaccggcgccgcagcatgcatccatatgagcggcgtgcgcttcatttttaatacatcggcccacatatatcgtaaaagcacggtcatgaccggtttcctccttttgaaaatgacactgcggaaacaaaacttattgcgataaaagaaagaatagaaagaataatagccggaatgatcacgtttccgtttaataagccgctgtttgcgggaagcggaattccgttcgggtggattccgagaatcggtgacatcagccggactgaccagctccacggactcagccaccacaatgaaccggacgccggcacaatgcctaaaacaaaggcggcgatcatattgatgagaatgactgccgtaaatccgaactgtctggcaatccataagcacaatgggatttcccaaagcgtcgtcagccacaaaagggagcttgcttcaacgcctttcagctgcagcgcagcaattgccggaaacacaaggccaagcaaaaacacgatgactaaaaagacgatttgcgacaggagtgaatacagcgcgatcaaacttatttttgagaaccatatgctttttaaatctgccggcaatgagtacaccgcgcggtcattcgctgattttttctcttttttaacagataaaccgcacattagagcaatcatgagcggcatgaaaataaccgcccaccaattgaacgtgcccgtcataaaataggccgcattcagcagaaaagaaaaagccgcgttcagaagcggaatcagaatgatcagctttctgataaatgttcttttagatgtaaggtgttccgcctgcatgtactgaatcattttcctgtccccgctttctcccgtgttgatttgacaacctccagaaacagccgctccagatcgtcttcccggctgatttctccctgatatcctaaaacgccgtcactgatgattccgatatggtctgcgatctgctccacttctgataacaggtggcttgataaaatcaccgtcattccctgtccgggcagggagcggataaattcccgcaaatcctgaatccccatcgggtccaatccgtttgtcggctcgtcaagaattaagagcgacggacggtttaataatgccaacgcgatgccgagacgctgtttcattcccatggaaaattgtccggcgcgcttttttccggttcccgttaatcccgtaatttccagcacctccgcaattcttgaatcaggcagtccgagcatcacgcagcggactttcagattttcagcggctgtcaggttgctgtaaagcggcggtgcttcaatcagggaaccgatgcttttcaaatcttcgcgcttccatgtatgtccctcgaacagaacctcgccggatgtttgctgcagcatgccggtcaatattttgagagtcgtcgattttcccgcgccgttcggaccgagcaggccgtatatactgttgcgcttaaccgatagagacacatcagccactgcctgttgtctgccgaatgatttttgcagctgtctcgtttctatgatgttgctcatatgattacccctctgctttgttatttgatatgtaagactttacagcgcagttatcaaaatttaatcaagaaatcaaaaaaagcatccttcacgcggaagaatgctttttttcatgaggctgagcgtacgatcagctttcttttttgttttttcacagggctgagggctcgttccagccacgccatcagcaggtctgcggccaccgccatcagcgcggtcggaatggcgcccgccagaataatggcggttccgtttgtcgcgttcgagcctctgacgatcatatccccgagaccgcctgcgccgacgaaagtgccgatcgctgtgatgccgatggcaatgacgagcgccgttcggagacccgccataatgacggaaagcgcaagcggcagctccaccatacgaaggatttggtatttcgtcatgcccatcgcttttcccgactcgagataagcgtgctcgatattgataatgcccgtgtgcgtatttctgagaatcggcagcagtgaatacaaaaacaaagccgtgatgaccgtattggcgccgagccccatgacaagcatcaggacggcgagcatcgcaagcgccggaacggtttgaatcacgttcgccacagcaaacacccagccggcgagacgcccgtgcctggctgtcacaattccggccggaatggcgaaaacggcggcgaaaacgacgccgtacgccgacatgagaaagtgccgccagcactcatacagaacatagctgccgttttgagcgtaatacgtaaacaactctttcatcgtgtccatccgcacatctcctttccgttattcaaagtaatgatgtttttctaaatattccttggccacgacggacggctcttttaatcggccgtcaacttcgtaattcattttctgcatcatctttgtatcaatcgcgccgatcattttattgatcacgccctccagttcgggatgctcttttaatacatgatccggaacgacgggtgaacagtcatacggaggaaagaaccgcttatcatccttcagcgttttcagtccgtaagcgatgattcttccgtcggtggaataagcgagcgcgatatccatctttctgcttttcagcgcgtcgtatacgaggccgatctgcattggatacgtgccttcaaatgacattccgtatgttttcataaaatcctgatatccgttgcctctcagcttcatccaatagttatctacgccgaatttcagatgggatgcttcttttttgacatcggataccgtttctaaatggtacttgctggcaagctgtccggaaacggtaaagacgtatgtattatcaaagccgtaagaatcaaaccatttcatgtcatatctgttttgaaattcacgctgaacgagccgcagcgctttgtccgggtctttttccggctccatgcgaagcgtcccggtcagcgcgtctcctgtatagcgcgtcgcggcgatatcaatatcaccgttgatcaaggattgctgctgtacggcgttggagccgagatttttaataacggatgttttcaacccgctgtgatgttcgatcatctgtccgagcatgcttgcgatgatttccgattcggtcatgctttgcgcgccgattttaatggtgtcctccgatgcggcgctcaatcccgggagcgagcatccgccaaggagcagcatgccgagacaggcgattgcgagcagccgttttttgcatctattccccatgtgagacctcctccttataaagcgtcctttatgcttttcagcccgtcaggcgtgactttccgttctgtcacccccagcatgtaatcgacggcggccgccagcatcgtgaccggaacggcgcctgcgataatatactccggctgataaaggttcaagccgataaaaatgtaatctcccagcccgcctccgccgataaaggaggcgagcgtcgcccagccgattaaataaatcgaagacgtcctgatgcccgccatgatgaccggggcggcaagcgggagctctacaagcctgatctgctcccatgccgtcatgccgattccttttcccgattccagaaggtgccgattgacgccgagaatccccgtatacgtgtttctgagaatcggcagcatggaatagaaaaacagcgccgcaacggccgggacctttcctacgcctaaaagcggaataaaaaacgcaagaatggcaaggctcggcaaggtttgaatgatgttgacgatgccgatgacggcgccggctcctcttttcatcctcgtcagcaggacgccgagcggaacggcggcgagaatgcccgccatgacggcgattaatgagatgtacagatgctcccatgttttataaagcatctctcctccatttgcctgtaaaaattgtacggtctgattcatatcaattgaagcctcctcatgacatcaccgcgagctgattctcttctccccagatggagtcatagacgatgtcaacgaggcttgcccttgtcacgattcccgttagccggccgtcctcatcaaggaccggcacaaatttcacgcctctttttaaaattttatggacggcgtcgcgaagcagagtgccgcttctgaccgtgtacagatcccgttcaagcacttccgcgacggttaccgcttgtcttcgtttgcggtcaatcatctccacatcgacataaccttggagaacgttcttttcatcaatgacgagcagcgaatccacccgctcggcacgcatcagctgaatggcggctgacagtgttttctcaggtgttaccgtcacgggatcgggattcatgatctgctccacccgttcaatatcagggctggatgattgaatcagccgttccttgccgataaactcctcaacaaattcattcgccggaaatctgagaatctcatcaggcgttccggcctggacgatttctcccgctttcagaatgacgattctgtctgcaagcttgatggcttcgtccatatcatgggtaacaaatacgatggttttatgtaaggttttttgcagttttttaaattcttcctgaagggaatctctcgtaatcgggtcaagcgccccgaacggttcatccattaagataagcggcggctctgcggcaagtgcccgtaatacacctattcgctgctgctgtcctccgctcagttcatgagggtaacggtctaaatattcaggccccatatcaacgagctttaaaagctcccgcgcccgttccttccgtttttcggcagaatgctttaaaagcttcggaacgagcgtaatgttctgctgaatggtcatatgcggaaacagcccgatctgctggatgacatagccgatgcttcttctgagttccaccgggtcttgttccataatgtttcggccctctatcaggattctgccttctgtcggttcaattaagcggttgatcattttcatcgtcgtcgttttgccgcagccgctcggtccgataaaacaaataaattcgcctttgtcgatattcaggttgatgctgttgacggcttttttcccgcctttatacgttttcgagacattttctaatgtcagcaaacactcacacctccgatattaaatttgttcaaatcgttaaattcaaatttaacttttcagacaattgaacgtttcccattataaattaaactttgtaaattaaaaagtttacaatttgtccatattatatataaaggttgtgtaagcactgatttacccgtattgaccggcaaagttcttcttattgctccgaattactgccaaattctctcggaagagcatttccgccggtttaaaaatgtggtatattgacatcggaattgctgactgaaaggattgaaactgttggagaaagatccgttacacgtaatcgaacaagctgaagatcatttgatagaacgaatcgctgaaaatatgcatacattcggaatgcccgcgacggtggggcgcattttaggcattatttatatgaaccgcaagccgatgaccttaactgaattatcagaagcgaccggcatgagcaaaacgagaatgagccaggcggtccgtgaaatgcttgacgtcaatctggcggaaaaagtgtttgaaaaaggcgtccgcaaagatttatacgacgtcgagcaggattactaccaaacctttattacgctgtttacggccacatggagcaaggtcgtcagcaaaaataaaatgatgcataaaaaactgaaccgcgaactgacggccgtccttgaaaacggcgtgccggaagaagctgaggaaaaaatcaacgaactgctgaaagaattaaaggattggcttgattactacaactggatcagccgtctgatcgagttttttgaaagcgaagaaatattcaagcatgttccgaagccataagaaaaaaaacgccctgacccgcaaggcgtttttttcatgccgcattcggcgctttggttcgttttttctttctcaccggactcagcgcccgctccagccatgccatcacaagatctgcgataacggccatcagcgctgtcggaatggcgccggctaaaataatcgctgttccgttcgtggcgtttgagcccctgacaatgatgtcaccgagtccgcccgcgccgacaaacgttccgattgccgtaatgccgatcgcgatgacaagggccgtccgcagccccgccatgatgacggaaagcgcaagcggcagttccaccatgcggagcacctgaaatttggtcatgcccatcgcttttcccgattcaagataagcgtgttcaatgctggcgattcctgtgtacgtattccggatgatcggaagaagcgaatataaaaacagcgacaaaatcaccgtattggcgccgagccccatgacgagcatcagcaccgcaagcatcgcaagcgccggcacggtctgaatcacgtttgtcaccgcgaatacccagccgcttaatgttctgtacctggcaatgaagatgccgagcgggacacctacgatcgccgcaaataaaacgccgtataccgacatgagaaaatggcggtaaaactcctgaagcacataggccccgttttgagaataataagtgccgagctgctgcagcacttccatttgccccacctcatttcttattcaaaataatgatgtttctccaaaaattctttagcgacgacggacggttctttcagcttgccgtccacctcgtaattcaattcctgcatcgtttccgtatcgattttgccgatcagtttattcacaatgcccttcagttcaggatgctgcttcagcacgctgtcgggaatgaccggcgaacagtcatacggcgggaaaaactgcttgtcgtcttttaaaattttcagatcgtacgctttaatccgtccgtccgttgaataagcgaggacggcgtccattttcccgtttttcacggcatcgtatacaagtccgatctgcatcggataggttgtgccgaattcaaaaccgtacgtgtcggtgaagcccttatagccgtcgccttttcttttcagccacgcattgtctacaccgagcttaaattgatccgcatgcttcttaatatcggatactttgtctaaatgatctttttccgcaagctctttcgtgacggtaaaagcgtatgtgttctcaaatccgtaagaatcaaaccatttgtaatggaagcgtttctcaaattccttctggacgatagataatgcttttttcgggtctttttccgcttccatgccgagggtgctcgttaaatccgttcccgagtagcgcgtcgcggcgatatcgatttcaccgccgagcatcgcctgctgctggacatagttcgatccgaggtttttaattaatgccgtattcaagtctgtattgtgctcaatcatctgtgcgagcatattggcgataatttctgattccgtcatgctttgcgccccgattttaatcgtatcatcggaagccccgctcaggccgggaagggaacagccgcccagaagcagagcagctgacagcgccagtgcgcacatccatctcttttggtttcttttcaaaacagccaactccttatgatacttccttcagtcctttcagccctttcggcgtcaccttccgttccgtcgccgccagcagataatcaatgataatggctaaaatggtgacgggcacggcgccgccgataatatattcaggctgatagagattcaggccgataaaaatatagtctccgagcccgccgcccccgataaaggaagcaagcgtcgcccagccgatcagataaatggtggatgtgcggatgcccgccataatcaccggaaccgcaagcggcagttccacaagcctgatctgctcccagaccgtcatcccgatgccttttcccgattccagcagatttttgtttacgccttgaatgccggtatacgtgtttcggagaatcggcagcaccgaatagaaaaacagcgcgacgatcgcgggcacctttcccacgcctaacagcgggataaaaaacgccagtatcgcgagactcggcaaggtctgcacaatgttgacggcgccgatgacggcgcctgcgccctttttcattctcgtcagcgccactccgagcggaacggcgacgacaatgcctaatatgacggcgatgatcgaaatgtataaatgctcccacgttttatataacagttctccgccgttcgtctgcaaaaacttgatcatttcattcattgtaagcgttcctccccttgtcagcctgtcaccagctggtcttcctcgccccagattgaatcgtaaacgatgtcgacaaggctcgcccgcgtgacaattccgactaaatgcctttgttcatcaacgacgggtacatatttcattccgcgctttaaaattttgcgtacggtatcacgcagcagtgtaccctgctcgaccgtatacagatcagagcggagcacgtcgccgacgaggctcgcttttttccggttctgatcaatgatctcgacatcgacatacccttgcagcacattcaggtcatcaacgacaagcagggaatcgacacggtgctcccgcatcacttggatcgcctgcgaaagtgttttgtccgccgtaacggtgacaggctttttgttcatcatctgctcgacgcgctcaatgtccggtcttgattgcaataaccgttctttgccgataaattcttcgacaaactcattagccggattccggagaatgtcatcaggagtgccggcctgaacgatctctcccgcttttaaaatgacgatccggtcagccagcttaatcgcttcatccatatcgtgggttacaaacacaatcgttttattcaatgttctttgcagttttttgaattcttcctgaagggaatcccgtgtaatcgggtcaagcgctccgaacggttcatccataagaataagaggcggttccgccgcaagggcgcgcagcacgccgattctctgctgctgtcccccgctcagctcgtgaggatagcggtctaaatattccgggcccatatcgacgagcttcaaaagctcccgcgcccgttccttccgcttttgttccggccatttcagcagtttcggcacgagagaaatgttctgctgaatggtcatatgagggaaaagtccgatctgctgaatgacgtagccgattttccgtctcagctccaccgggtcctgctccataatgttttcgccatcgataaaaatctttccggatgacggctcaatcagtctgttaatcattttcatcgtcgtcgtttttccgcagccgctcggcccgataaaacaaataaactcgcctttttcgatatttaaatcaatgctgttgacagctttttttccgcctttatagactttcgatacattttctaatctcagcaatccgtgcacctccgaagggttccgttatttttctgaaaagtataatctttattataagatgaaatttgtaaaataaaaagtttacaatgtgttgaaattatatacaatatacgtattttttcatgttatcccgctgacaatgcggatgttcttacaatcgctcccgatagctcgcatatcctgccgcatcatctttttcatcaactgtaaaaaatatgatatattgtcagcatgaaaagccagtgaagggatgatcagccgtggaaaaaaacgctcttgatatcatcgggcatgctgaagagcatctcattgagagaatcgccgagaatatgcatacattcggaatgccggccacacttggtcgtgtgctcggtattatttatatgaaccgcaagccgatgacgttaaatgagctgtcagaggcaaccgggatgagcaaaacgaggatgagccaggtggtccgtgaaatgactgatgccaatctggcggaaaaagtgtttgaaaaaggcgttcgcaaagacctttacgacgtggagcgtgattattaccagacgtttatctccctgtttacggcaaattggacaaaggcggtcagcaaaaacaaaatgctctataaaaagctgaaccgcgagctgactgagcttctggaatcggaaaatctcagtcccgatattgaagaaaaagcccgtcagcttttggatgaactgacggattggctccattattatgactggctgagccgtttgatagaattttttgagagtgaagaagtgtttcagcatgtgccgaaaatagaaaaaagcagcccccgaagataaccgggcgctgcttttttaagtcaggaaaccaatatcgggaacatgcctttcagaccggcgccgatcatgccgatcgccaccaccgccaaaatcagccccatcagtcgggtaatgacgttcatttcggttttcccgagcttattgctgatgaaagaagaatagtgaaagaagatgaacgtcatcgcgatgacggccgcaatgccgataagcacgctgatgtaatggatgatgccgccatggccggccgacagactcatcaccgtcgcgatcgtaccgggtccggcgataatcggaatcgacaaaggcgtcacggatatatcggctttctccttgctctcccctttctcttcatgatggagagactgtacatgagatttcttcgcgttcagaagattataagcgatgccgaaaataaaaatgccgcccgcgatacgcaaggcatgaatgttaatgtcgaacagtttaaagatcagatggccgaaaattaaaaaagcagccaagatgataaacgacagcacggaagccttgcgtgcgatcgctgtccgttctttctccgggtatccttccgtcagtgaaagaaaaatcggcacgtttccgatgggattggagactgcaaacagtgaaatgaagacatgaatgatgaatgaaaacatgcgtacctccttatgacttgccgttattgagttatgttttgttctccgctgtttcttatgcatgatttttaccccggggtctgctttttataacctcagccggacgatccggaaaacagaaaaaaaccgtccttgtaaggacggtttttttctgtttgctatctccataagccttttccgaatttcaacagccgataaagcattttcaatttttttagcatgcgttaatttcctttttcactctgaatcaatgcgccgagagacatgatatctatcagctccaataaaattctaccataatgggtactttttctctattatcaattcatagagaaggtgatttatatatctttagaaaactccgttacatccgtcctattttcttttataatgtaaatattgaacaaaatccctatattacttgtaaaaggagttttagaatgtattgttctcaatgcggccatcatactgatggcggaaaattttgtgaaaaatgcggtgcgccccagcccgggcagggaggcgcaggccaaacacagggtcaggccgctcaggccggcgccgcggctaagcaggcttcaaagcaatttgccttattcgtgcttgatgtgttaaagagaccgtatcaaacatgtaaaacgacaggcggcgaacagcttgtcagcagcatcatcaacatggtgcttttctgcctggtgacgccgattatgttttatattctcttatcagacggctttcgtgacgtcagttttaccgcggttgtgatcaaaccggcgcttacctttgcattatgcgttttctgcctgtatctcttgatttttatcgctttgaaggccggcggcgcgcaggtgtcatttaaagattcgctgtccagattcggagcatttttgattccgtttacagctattttgcttcttgccctcatttttatgctgcttcatacaaccgtttgctttaccattctggctgtcggtcttttaggagcggcgtttgccgtgcctccgctcatgctggcgagctatcagcatcagctcactgctaaggcggatatcatttattctgttatcgtcatctatttgatcatttgcgtaacgtttcaattcacgatcaagcattatatgaaagaactcatgaattatttcttcttttaaaaacggaaacccccgccgcctgattggcgcgggggtttttttattgaatggatgttaaataaattcttccgtctttgacaacgccgccatacgtccaattgtatgttctgagcttcggactgccgccggctttcgtaatataaaactcctcgtacgtatgaatcgtcagatgagagcctttctgtgaaaagcttttgacattcactttattaaatacttcagtcgtcccctcgctgtacagttttttgaccagtttctgctgatcagcatacaaagggcttccctcttctaaattgcccgccatgatggcaaaattgttaaggctgacggcgcttgattgatttgtcaggtaatcagtcataaacgatgtgacttgctcgtttgtcacgctgcctgaagctgtatttcctttggaagatgcccatgcggatgtataggttttcggctggtcgttttttattttttttacatttgtcccagaagaatctgaggctggatcagctttttcaaaaacccattttttatgttttgtatcatatgagagtacataatgaaagctcggctcagcctcttccatatcaggcttcgtattcccgtcgaaataagcagactcatgaagctctttacccgtaacagttacttgccagcggccgttctcttgagaaatcgcaaatgaatccagatcaaagcttgtctctttatactgatctttcaaaaaggtgccggaactcttcatgccggataccacttctttcgtctgctctttccaggcggaaccagcctcggtcatctgatcggtatttccgtctgccatcgcttttgtatactgcttcgttgttttgacaatcgtgtccatgattgtttgttgtgtatcttgatccgggataagcgttaattccatatcagtaccgttgatcggaacatcggcagttttcatttttccccaaggaaaatcagcctccacggcggctgtcatggaaccgtcagttaagagcggaccgtatgtaacggatgtaaacggatctttatggacggacttgccgtttatcagcagatcgcctttcgcgcttttgaagctgtctgccggagtgaacgtcacatcctcggcgtctaacggcagatcaaaatcaacattccggctgccggccgcctctgcctcttgctttttgacaacgtcaaccgtgtcatttttaagcttggcttccgccgtgtagacaccgggtgcatacgggccgaagatttgggtttcatcggcttttttgaccgtccctgttttctcgctgttgatataaagatcggcgcctttataattgctggtgacgcggaaataaaccggatcgactttcagttcgtaatggtcaaacaaaagaagggttttaccctcttttttgacgtataccgcatctttttctgatgaattgccgcgaagcgtttccagcagttcatcgtgtttctttgcgtatgcaaggagcggtttgacattggtctcattcagcttcagttttttgtctgaaggagtgagcagggctgcgagctttttcgtgtccccgtcatgaaccgcctgttcgaattgatccgtgagccttttttcagatgtcagccaggctccggttttatatgcggcaatcaataagatcagcgctgcggctatgccgccccatatgaagagcgtttttttagggatcggctttctcatttgtgaagcaggttcagccgctcttacagccgcctgccgttcaagccggcttcctttcccgatcggttttccgcattctttacagaaatgcgcctcttcgttgttctgtcggccgcaatacttacaaaaaaacatgactttcctcctattcaatctacaaaacttgtataacttttcctatgtttcatattttataataaagtagaatgattttggagttattttgaaaaatagctgtcgatcataacggaggaggagaaacggacatgcaaaaactgagcatccgaaaagccgcggatccggatgaagcgctgtatgaactattgctgctggccgatccgtcgaaagagattgtcgatgattatcttgtaagaggagaatgctatacggcttggacgtcagacgagcttgcaggggtttacgttttattgcaaacaaggcctaaaacgatagaaatcgtaaacatcgcggtaaaagaatcgctgcagaacaggggattcggaaaacagctggtgcaagatgccattgaaaaagcgagacaatcgggagctgacacgattgaaatcggcaccggaaattccagtattcatcagctgtcactctatcaaaaatgcggattccgcattcaggctgtcgaccatgatttttttatcagacattatgatgaagacatttttgaaaacggcattcaatgcctggatatgatacggctttatttggatttatgataaaaagggcgccggctgataccggcgcaccttcgtttaccattcagacggattgatccgcttgtttctctgaatttctttgactcccttgtctgactgaaaaaacagcaaaaacgatcgtaagggtcagtccgaccgccgcaaaaatataatccgcattcatcaacagcagaagccctgtgtagacagcggcagacagcggttcacccattttgacaatggaaaaaatcagtgcaaaaacccttccgaaatatgcggccggaaccgtcttttggaaatacagcaccgtttgcacatcaatatacgagatgatgatgccaagcaccaggaaaatgatgcactcaaacccgtgaagcggaaaaaacagcaccaaaatgagcagtcccgctgccgttaacgtccgcggatacagccggttcaagcgttttgtattccatttgaaaaatacggccagattgcccaaaagcatccccgcctgaaacattgaatacatgacggcaaaccatacagaatagttctgctgaaaacgttccacagcaagaatcggccccattactgaaataagaccggcaatgacgagatttacgacgaaaaagtatccgaccgatgtcagccatgccgcatttcctttcagcattctgtagccggcttttacatcttcagccccgttgcttttttcattgggctgttctgaaatacgaatgaacgcgataaatgccgcggagataaaaaaagcagttccgtttatggcaaacagcagcccgaacggaatagccgcaatcatgattccgctgatcagttttccgacgatgagtccgatcaagtcactcgtattgatcagagatgtcgcctgatcaagatgctgtttgcggacgagcagcggaatgatcgcgactttcgccggcgcaaacagcatcgattgcagagatagacaaaaggcgcacacccctgctatccacacggttaataaatcgttcgcgctgagcaccgccaagaggatcatgatgacggcccggcccgtattgcacaaatacaagatcgacttttttcggaataaatcaatcagcggtcccgccagcacgccaaatgtcaacggcacgagttcgataaaagaaataacgccgacaagaattttactgccggtcaattccagcactaacagcggcagtgcaataagccagataccgtccgccgctgaagaaaacacctgcgcacaccaaagctttgcatagttcggtgttcgatatgtcatatcaggcccttttttgatcctcggcatcagaaacaccgccgaaccattccagcgttctccatgattcccgtctttccgtataatcctcttccatcacctcaaatacaatgccggtatcttgattccgataaagctcctgcaaagtatcggcagcccgtctcagcagctcctcagcgatcgtcccttcactcggatggcggccctcaaaacagcggacgccgccatgcgggaacgcaagctggcgaaatgagctgaagtgataatgtttaatgctctcttttatcgagagaaactgaaagaaatccgggtatctcagctggtcatttctgaacataagcgcggaagacaagtgagtctgataggtaatcgcccaatggcacagatcccacgtaataccgacatgcttcagatccagctgaaccagctctgtaaaatcctcaggataaatgaaaatcggatcaaaatcctctcccagattcccgatgatcggaaggttttccacaccgatccaaatgtccgtccctttcagctgctcatcaaactctgcgaaaaactcaatgatttttttacggtttccttccaggtcatacacttgaaattcctcaaccgtcataaattgattcgcatgaacggttatgcctttggcgccgtatttcacagcgagctccgcaaagtgataaagctgttttttgatgtgatcttcatgcacataatcggcatgatctgtcgggaaatgcagcgtcaataatgaaggatcaagctgttttgcatattccagcgtctgattgaatgttttgagataatccgcttcactaaaggagcggccgtcaaaaatattcgcttccagaccgtatcccgcttccacccatttctcatcgatttgcttcggatcaagtccgaaaaacggaatttgagcaatcataggacagtcaccatgttcctctcacaagcataaacgcttccgcagcggaaaaacccgattttgctccccatacacgggcattatgttcgattgcctgcaaagagcggggatgagggaagtctctgagctcggagccgtaacacgccatcgatttcaattttgtttcaagctcgtcttcaatattaacgaagaaattggcatgaaactgatccttctgacagtaattccattccgtcgaagacaatgtttcataggcaaaaacccgttttaccgtatggccgggaagcggacgggttgcggtcatgaccgctctgaatacgacggagtggtcaatattaatgtcaccgccgtactgggtatacacaatgtcaggctgaaaacgattgatttgtttctccgcttccttcacgacatccagcaaatccattgaatccattctgttatcaggaaggttcagcctgacaaaatcatggatgcccaaagtgctgagcgcttgttccgtttcttgagcagaatgctgcataacagactcttcaggcttctcataatccgtttttcttgatgacttgccttccgccataatgactgccgacacgctgtcaccttggcggacatgtttggcgagcgtgccgccgacgccgataatttcatcgtcgggatgcgctgcaaataccattactttcatcatattgccctcctttaactaacatttcagctgtatccgctccgcagttcatcagcatatcaagcatggagaggtgagggatatgctccccgaataattgaggatagtcaaaatgccggatctgctgatactcaatgacaattccgtttctttcaaaatcgctttctattaaatagtcggaaccctgactgcctgaataataacgatccgcccccagctcctgacaaagcgctaaaacaaaatcgctttttttctccttccggcattcaagctcagagacataacagagcggcgtttcgattcggagctcttttcggaaaaattcaatgatgtgcatattcaaatcatggagatattcccactccctctgatagacatcttgaaaaaaatgctggtaccgctcaaaatagggagctttcgcatagttcatcttaatcgccatccaatgttttttccgccaatcctgtgtctggtcgattttcatatgccgaagctctatgtctttatattgtttcatctgcaaaggcaccgtcagccatctggggccctgcggcgttttgattctgttgcggttcagaaacccttttttctcaaattgagccgtgtcatgaatggcaaacagatccgacttatacattttttcaaaaaaaccgtaccacggcagataactggattgatggccgcttattgttttcattccggtttcgtaaaaagtcggcattgtttttcttcagctccccaatatcgtttcggtcttgcgatttctttactgtgtgaatagccaaaatcagcccattgaagcttgcggcaaatggcgaattgcaaagcgtcacgcatcaacaagtaagaggcctgcgctttttttcccgccaggctgtttacattctgccaataatagaaatgagagcggtcatagagaaaaatactgctgctgatcagcgtctcatcctgatatgctccgacccaaaacatccggtccccaaacgtgtcaagcagtttttggaaaaatccttggctcagcacataagcagcgccgattgccgccgtatgctccttgtagaggtcgtaaaatgattcaagttcttgtcgcccgatcagcctggtgacaatattctctttttcagcgtatctgactgccgtccgggcttttccggaaatgcccgtccaaagttcgtcaaacgtgtccggaagcgtaagaatccgtgtcgccttttccgtccacccttccccgatttcttctgtaaaagaagtctgaccgtacggcagcagcatccgggatatgttccggccgaatatggcctcgatttcactttgaagccattcaaatgagatggggcgatctgaaataacgccgccgtatccgatcatattgccggataatacgcccttctgttcaaaaagcggaagatagatgacctgtcctccgtccgttgtcagtctgacagggtgaaatgacgtgccgggaagctcttccatgagaattccccaatcatagctttgaaacaaccccgcctgatacatgtcagcggcccgatcccatgcctggcggctcgtgcatactgctgttttttgcattgttatcaccactattcagtcttattcttttgctcacaatatgataaaacggattcggctatatatctgacttgctccttttgaagaggaggtttaaacggcagagaaagaactcttttccaaagcggatcttccccttcttccgccgcatatgtttcataaatcggaatacgtccgaggggaagatagttccagcatgtttggatgcctctttcagctaaataaacggaacacccgtaccgctcttcatcccgggggaatacaatcgttaaataattcagatgttctccttcttggggctggatcatctttatgccgtacgtctcttccgcctttataaagatttctcccgccgcttgtaagtttcggagcgaagctgttacaagctgatccataagtgaaagctgatcttcaataatggcttcccttgccggatgcatgcgaagcaccggtacaacagccggtttatccggcagagcttcgagcttagtggctttcatggaaggcatgatgcccgctttcctataaatatatgaaacgggatgatgccgtttccgtttcataacagcctgtattctttgatttctgatataaattcgatagtcagctgccacttggctgcgctgttccatcgggaaatttgctttttgccgaagccattctttcggcgcgattaacgcgccgcctccgatactcgcaagcggttttgacgggccgaagcttaaaacaccgaaatcgcccagaccgccggcatatgtatccgcttgttttgtaaacatggcttgagcggcatcatcaatgacaaaaataccgtgttccttcgcccagtcaatgatggcggtattttctctccggccgtatacgtgcgtgaggataaccgcacacgtctgccgcgtcgctctttttttgacatcctcaaacgataaagaaagatgctcatccagctgcgcaaaaacaggcgttgcaccggattgcaatacggcatcaatgacattcgggcagctgaaggatgagaaaatcacttctttccccggcccggctcccgaataagttaaggcgagcaccagtgccgcactgccgctggaggtcagcacaaccccttttccgtaccgtttttccagtttttcagtcagtccgctttgtccgccagtaagcaagtgcttcaccgcgcgcagacggtccctgacggaaagctgtccgggataaacgggatatttgactacttccgggttttcaggaaagtgaaagtttgtgcttttgtctttcatcttttatgatctccaggccttcattcagacttacttttggatcgtaaccgagtaaacgtttcgccttctcgattgacggcgcccgtttaaaaatctcgatgtcttttcccctcacgccgtcttcgcccagctttttaaacagatagttatccttctctctgccagagagcacattgactttttcagccagttcttttatcgtgatcggctggtcgttcccgatattaaagtcttcaaagacggctccttcatgaatgagcgcgagataagttccggtgacgatatcactgatgtagctgaagcagcgtatttgtccgccgtccccgtaaagaggcagctcagagccattctcggccaggctgaaaaacttgttgatgacaaaatcctcgcgctgtttcggcccgtatacattaaagtaccggacgacccgaatatgaagcttgtcggaagcctgttctctcaaatattcctctgattgcagtttggcttttccgtaagccgatttcggaagctttctgcttgtctcggtataaggaaaatcaggtgaatctccgaatacttctgagctcgatgagaaaagaagtgttctgattcccaattcaccgcatacctcggtgacatttttcgttccttcaaaattaacccgtatgacgtcttcttcattgcttcggcagctgtctacaccgaccattgccgccaaatggacaaccgcatccgctccccgcagtgattcgcggagggacgtccgatcaaggatatccgtttggcggtattcagtgtcaaaagccggctccttttggtctgcaataatggtgtgataacctttagcctgtaataatgccgccaattcgcttccgataaaaccggctcctccgataatcgcaatatgtttcatgatcctacctcctggctgatagtcaaaacttcttttatagacttgacaatatagctgcaatcctcatctgataactggctgtaaagaggcagtgacacgatctcccggaaaacacgttcagtaaccggcagctcggccggaaaatgtttttgatagtaaggatgcatatgcacgggaataaagtgcacgctcagcccgatctgtttttctttcattttctcaataaacagatctctgtccatgccgccgttctctcggatccgcaaaataaataaatgccatgagtgcgttatgccgttcggaatgtcagaaagcggaagcgctgctttgtcagattggcccgacagttcacgtacataaaattgagcgatctgtgcccgtttttcttgaatttcgtttgcgcgcttcaattgaaccagaccgagcgcggcctgaatatccgtcatattatatttaaagcccggcagtaacacgtcgtatctccagctgcctttttcaccgtaccggttccaggcattttttgtgatgccgtgccagccgtacagcctcgctctttctgcggcctgttcgtctttcatgacgagggctccgccttcccccgttgtaatatttttggtggcataaaagctgaagcacacggcatcgccgtgagtgccgatcatgcttccgttatattttgtaccgagcgcatgagcggcgtcttcaatcagatacaatccgttttctttacaaatggactgcaagttttccagatcagccggatagccggcaaaatgaaccgcaattaccgcttttgtgcgcggcgttattttcttcctgacatcttcaggatcggcacatagacttttctcgcatatatccgcaaacacaggaacggctccggcgtgcaggatgacattgacgctggaacagaacgtgaagctcggcacgatgacttcatcgccttctcccacaccgagcgccaataaagccatgtgtaatgcagcggttcctgaattacagctgatgacgtgttcggctccaatacattctcccagctttttttcaaaatcgattaccttcgggcctttcgaaatccagcccgactgaatcgtttcggttacgcttgcgatttcttcgtttgtcatatcaggtctgtgaaaagagataaatcgattactaatgaccgttccctcctataaagtgacaactctgcaattgtcggctgatttttccctgcatacatttcttgtgtcaaagataatcggtgaggcatccttcaaaatactgtagtcgattacatcgtgatctgtatgaatgatgatgacgtcgtactgattgatttgttcttttgtgaaagggacagattgtttgcggcttccgtcattcaagcggatctcgctgataaacggatcatgataatcaatcgcgcatcccttgtccatcaattcttccattatcgtaaacactgaggattcacgcgggtcatttgtattttttttataagcggcccctattattaagatgctgcatttgtctttgcccgccagtttcaaagcatagtcagagacagaaatcggcatgttagaattgatttcgtccgccagatcaattaattttgtctgcagccctttttcattcgcgatccatttgaagtaaaaaggatcaatcgggatacaatggcctccgactccggggccagggataaatttttgaaagccgaacggcttcgtgtccgccgcgcagatgacttcccatatatcaatatcaagttcacggcaattaagcgccatttcattgataagagctatattgacataacgataagtattctctaggagtttagctgtttcagctacttcgggtgaggtgaccgggtgaatgcttgtaacaatggtgttgtaaaacgctgaggcaagttctgtgcaagtctgtgtggttccgccgactactttaggaatatctgaaacttcatattgcctgttgcccggatcgattctttccggagaataagccgtaaaaaagtctgttcctattttcatgccgcggcttgatgccattctgtcggcaatcttttttttcgttgttccgggataggtggtgctttctaaaattaaaagctgatgctgccttccataagcgatcatgctgtcaactgcactgtcgatgtaggttaaatcggggatcttgtcttttttgttcaggggtgtcggcacacatatcacaatgatgtcgcatttttggatgagcgacatgtcggcactgatttgaaagcgttttgtttgtaaagccgagttcagtctgccgtcctctatatcttgaatatggctgcttccggcggctaacaaggaaaccttttcactgtttttgtcaaatccgatcacattgtatcctttatcgacacattccagcgcaagaggaaatcccacatatcccatgcctaacacgcctactatcgcctgcttcgtttcaatcagatgtaacagccgtttttgaccaaggttgctggcttcttttgtgacagtattcatttttcgccccctaatagatagaaaagagtattgttttttacaatttaaaacaaatatcgatcgatatcgcaattataacaaaagttaaaatttgataaatgagttttacatccttttgtgaattaggtattatctatttatttttcttttatttgtaaaataaaatcctgttaaatggtatatatctggtaacgagtgagaaaatctcccttaattgatagaatatacagaaaataatataaaaaaacaggccgaagcctgttttttattccttcattgcctcagttactgccgcggaaacgagtgctccagctttctctagccgttctttgctgatgtgtttcatattatcattttcggtgtggtaccagggccccggctcctgtgtatcggggctgagccaaatccagttagccgacggaatccccgcttcataaaaagagacatggtctgagtaaccgagctgaatcaggtttggcttgaccaaccgggatttttcagcggctttttcagcataccggacactcgggtttttcctgccgtcaggagtcgtgacacacatttgactcgcttcttcccagtcagtcgcaatcatatcggcattaaaattggcccggctgtgctttctttcattgttcgtgagtgtactgacgtaataagatgaacccgcagaccataattcttctgcaccgaacaggataaagcggatctctttgtctttcggtatatgtttgagttgcttgctgatttccagaacggcagatgtgcctgaggcgttatcatccgctccgggcgcgccttttacgctgtcataatgcgctgtgacataaataatatcagcatcagaagagttggcctgtgccgctttgcgcgttcctataatattttgtgaggtgcggtttttatagtttttaaattgaatgactgccttcttttcctgaagcaatgcttcaccgtcttcttttttcatacccgccgccggtatcgtgattcctttatcggtatgcggacggacggcgagcggttttgttgtctgattataaataatgactgctttggctcccgcttgttcggcatgtttgatcttttgagaaacagggatctttccttcgcgtatcactgcaatctttccttcggctcctgttacgtcattgcgtgatccgcagccgccgtcaaaaatcccgccttctattttgagctctttttcaacagcggattgatcagcggagcggagcgggaattcatgatctcccgctgtgactgaacctgaaaagtactttttcaatggaaatgactgtactttgacactggcgccctgagcccgcagacgattcgatatgtattcagccgcttccttttctttcgcagttccggtttcccgcggaccgatggtttcactcagatcatgcatagtgtccaatgcctcatcagcatcaaaaaccggcgcggtcacagttgaataagcatgagtttcggacagcggcccggcagacgcgccccatatgacgcttgctgccaccgcggctgacataaatgaaaatttcatcataatccctcctcttattaacacctcttccctttcgattgaagaacactgattcctttaaaaaggggaaaaatgaatattattgaccaaatgaagatgatgaaaaaggagggaaaagcccgggaccataaaaaaacgccgggagatattctcccggcgtccattacattacttatttaagttatagaaagagttgataccgtgatattgagcagtttcagccaactgatcttcgatgcgaagaagctggttgtatttcgcaacacggtccgtacgggacggagcacctgttttgatttgtcctgcattagttgccacagcgatgtcagcgattgtgctgtcttcagtttcaccggaacggtgagagataacggcagtgtagcctgcgcgtttcgccatttcgatcgcatcgaatgtttcagtcaatgtaccgatttggtttactttgatcaggatagagttgcctacgccgtttttgataccttcagcaagctttttcgtgtttgtaacgaaaaggtcgtcaccgacaagctgaacttttttgccaagacgctctgtaagaagtttgtggccttcccagtcgttctcgtcaagtccgtcttcgatagagatgattgggtatttagaaaccatttcttcgtaccagtcaaccatttcagcagatgttttcacaacgccttcgccagacagatggtatttaccgtcttctttgttgtagaactcagaagatgcagcatccatagcaagcttcacttcttcgccaggtttgaagccggctttttcgattgcttcaacgattgtttgaagcgcttcttcgttagaaccaaggttcggagcgaatccgccttcgtcacctacagctgtgttcattcctttagcagaaagaactgatttcaggctgtggaagatttgagcgcccatgcgaagcgcttcacggaagttaggcgcgcctacaggcataatcatgaattcttgaatgtctacgttgttgtcagcatgctctccgccgtttacgatgttcatcatcggtacaggaagcgtttttgagttgaatcctccaaggtattggtaaagaggaatctgtaagaaatcagcagctgcgcgcgcacaagccatagatacgccaaggattgcgttcgcaccgagtttgcctttgttttcagtaccgtcaagctcgattaaaagctgatcgattgcgttttgttcagttacgtcaaagccgagaagctctggagcaatgatttcgtttacgttgttaacagcagttaacacgccttttccaaggtaacggtctttgtcgccgtcacgaagctcaaccgcttcgtattcacctgtagaagctccgcttggcactaatgcgcggccgaaagctcctgtttctgtatatacttcaacttcaactgtcgggttgccgcgggagtcaaggacttcgcgtgcataaacatcaacaatgtatggcatgagtttgtctctccttttgatttacgcttatttttgaattaaagatgttccggtcatttctttcggtttttcaacaccgagaaggtctaataacgttggtgcgaggtcgcctaggattccgccttcgcgcagcgtcacgccttctttcgtcacaatgacagggactgggtttgtcgtatgggcagtgtgcggttcgcctgtttctgtaatcagaatgtccgcattaccgtgatcagcggtaatgatggcatgaccgcctttagcgataatggcgtcaaccacttcgcctaagcattcgtccactgcttcaattgctttaatcgtcggttcgaccattccggagtggccgaccatgtcagggtttgcaaagttcaggatgatcgcgtcgtgcttgtcagccgcgatttcttttacaagagcatccttcacttcatacgcgctcatttcaggcttcaggtcatatgtcgcgaccttcggcgagttaatgaggatgcgctcttcgcccgggaattcttcttcgcggccgccgctcataaagaacgtaacgtgcggatacttttcagtttctgcaatgcgaagctgttttaacccgtgctgtgctaatacttcaccgaccgtattgtcaaggtttaccggtttaaaagccacatatccgtcaacagattcactgaagtgagtcaggcagacgaaatacaggtttttcggatgattttcaccgcggtcgaaatcgcggaaatctttgttggtaaacgtgtttgaaatctggatggcgcggtctggtctgaaattatagaaaatcacagaatcgccgtcatgaattttcgcaatgggttcaccgttttcttttgtgatgacggacggaatgacgaattcatcatgaatgccgttcgcataagaatcgtcgactacatccatcgcgctgcggtaagacgggccttcgccgtaagccattgcgcggtacgctttttccacacggtcccagcgtttgtcgcggtccatggagtagtagcgtccggaaatgctggcgatttcgccgacaccgatttcttcgatctgctcattcagctgctgaatgtaagttttcgccgtttgcggacctacatcgcggccgtcgaggaaaccgtgaatatacaccttcgtcagtccttcacttttcgcaagtttcagcagcgcgaataaatgattgatgtgactgtgtacgcctccgtcagaaagaaggccgaacaggtgcagcgctttgtcgttgtctttcgcgtttttgatggcgtcaaggaacgtttgattgcgttcgaattcgccttcgcggatggcaacgttcacgcgtgttaagctttggtacacaatacgtccggcgccgatatttaaatgaccgacttcagagttccccatctgtccttcaggcagtccgactgcttcgcctgatgccgtcagcgtctgatgagggtattggttccaataacggtcgaaattcggttttttcgcttgtgcgactgcgtttccgactgtttcattgcgtaatccgaacccatcaagaatgatgagtgcagctggttttttactcatattgaccttcctccaataattgaacgaatgactgcggttcaaggcttgcgccgccgaccaaagcaccgtcaatatcggactctgccatatattctttaatatttgcaggttttacgctgccgccgtattgaatgcggagcttgtcagcagtttcctgactgaagctttcagcaacgactttacggatatgcgcgcagacgtcgtttgcatctttcgctgtagaagatttgcctgttccgattgcccagattggctcgtacgcaataacggaagcagcaacttgctcttcagaaagacccgcaagcccttttttcacttgatcggcaacaagatcatttgtttttccggcttcgcgctcttcaagcgtttcacctacgcaaatgatcggcacaatgccgtgtttgaaagcggcatgcgcttttttgttaactgtttcatcagtttcagcgaacatttcacggcgctcagagtggccgatgacgcagtaatccacgccaaggtctttcagagcgaccgggctgatttcacctgtgaacgcaccgttttcttcaaaatgcatgttttgggcgccgactttcaggtcagttcctttaacagcagaagtcagcttttctaagaaaagagctggtgcgcaaacaacggcttccgctttgtctgctgctggaatggaagatttcacttcttcaacgaagctgacagcttcgccgagtgttttgttcattttccagttaccggctataattggttttctcatctgttccacttccttatagcagtttttatttatcgttcagcgcagctacacccggaagctctttgccttccatgaattcaagggatgcgccgccgcctgttgagatatggctcattttgtcagcaaggccgaatttttcaacggctgccgcagagtctcctccgccgatgacagagtatgtatcgtttgcctctgccaatgcttcagccactgcttttgtgccttgagcgaacaagtcgatttcgaatacgcccataggtccgttccatacgacaagtttgctgtttttgataacttcagcgtacgtttcgcgggttttcgttccgatgtcgatcgcttctaaatcacttgggatctcagagatcggcacgatttgaacgtttgcatcgttagagaaatcatcagcaacgagaacgtcttccggcatatagaatttaacgcctttttctttcgcgcggtccatgaatgattttgcaagttcgattttatcttcttcaagaagagatttaccgacttcatagccaagcgcttttacgaatgtgtaagcaagacctccgccgatgatcaggttgtccactttatcaagcagactttcgattacgccgattttgtcttttactttcgcgccgccgatgattgccgtaaacgggcgctcaggatttgtcacggctttgccgagaacgtcaagctctttttccatcaggaatcctgcaaccgccggcagatgctcggcaattccggctgtagatgcgtgagcacggtgggcagcaccgaatgcgtcattgacatatacatccgcaagctcagcaaatgctttagcaagctcaggatcgtttttctcttcaccagggtagaaacgtacgttttccaatacaagaacgtctccgtccttcatatcagaaatttgtgcttttacagcatcgccgtaagcttcatccgcttttttcacttcttttccgagcagttcgcctaagcgtgcagcgacaggagttaaacgaagctcctcaaccacttcgcctttcgggcggcctaagtggctcgcaagaaggactttcgcgccttggtctgcaaggtgtttgattgttggaagcgcagctcggatacgagtatcgtctgttacttccccgtctttcattggaacgttaaagtcaacgcggcagaatacgactttgccttttacgtcgatgtcttttactgtttttttattcatgccttaggagatcctccttcaaaatggtttgcatagcacgaaaaacgtgaaacgtgaaaccgcctcatgatgcttccgccgcggggcagattgcagcttccgggcacggggcagatcgtcttctgagccagggcaggcggctcagaaaacgaaagtgccgcggaaacttcaaaacgcggacgttctgcagcaatccggcgctttctgaaagccggttctcatggaaaaagggaaagggagtccgtccccttcccttgtccgctttcattatagcgtttctgtccgaaagaaccaagtccggccctttccgggagctatgaattaaagaccttgttttgcgatgtaagctgcaaggtcaacaacgcggttagagtagccgctttcgttatcgtaccaagagattacttttaccatgctgccttccataaccattgtagaaagagcatcgattgtagaagagttagcattgccgttgtagtctccggatactaatggctcttcgctgtagccgaggattcctttaagatcgccttcagccgcttctttaagagctgcgtttacgtcttcagccgttacgtctttgttaagttcagcaactaggtcaacaagagaaacgtttggagtcggcacacgcatagctccgccgttcagtttgcctttcagttcaggaagaacaagggaaactgctttagcagcaccagttgatgtaggaatgatgttttcagctgctgcacgcgcacgacggtagtctttgtgcggaagatcaagaatttgctgatcgtttgtgtaagagtgaacagttgtcatcataccgcgtttgatgccgaatttgtcgttaagtacttttgcaaacggcgcaaggcagtttgttgtgcaagatgcgttagagataacatggtggttagccgcatcgtatttgtcttcgttaacacccataacgattgtgatatcttcttcgttagcaggtgcagagatgataacttttttcgcgcctgcttctaagtgtttcgcagcgtctgcgcgttttgtgaagaaaccagtagattcaactacgatttcaacgccttgtttgccccagctgagtttcgcaggatcgcgctcagcagaaacttcgattgttttgccgttaacaacaaggttgctgccgtcaactttaacttctgcatctaattttccgtgtacggaatcatattgtaaaagatgagcaagcatgttagcgtctgttaaatcgttaactgctactacctcaacttcaggattgtttaatgctgcgcggaatacgttacgtccaatacgaccaaaaccgttaataccgacttttactgccatgattatttcctcctttaaataagtgagagatatttatattgagggactgttatcccttaataacttctttgcggctccttcgtccgtgacgagaaccgtgtttcgctgctttttaaaataagcttcgattgcttctgcttttgatgatccgcccgctaccgcgataatgtcgggaatggcatcgaggtcatcgagctgcattccgactgaatgcaccttgtgaacgacttctccgtccgcattaaagtagtagccgaatgcctctgtcaccgcatgattgtcatctattttcttcaaatcttccaaaggcgtgtttcttcgctccgccattgttctagcttcgccgattccgtgaacgagcatactcgctgatttaatcgtgtgaagcacctcttttacggaaggctcttcaataatagatgagtaggcgccttgtgacagctggccgggaacgaacaaaagccggtaagtgcctgaagccttttccgccatatgcgcgcatatggtgttcgcctggtttttcacatcttcgcctaaaccgcctcttgcgggcacaaacaggagctcgcggttttttgaatccggcgtcatcatatcggcgacggcttcaattgtcgtaccgccggttacagcgacgatatttttgcctgaaaatctctttttcatacatgcaacggccgctctccctaattcttttttgacccaaggagattggtcgctgtctccggaaacgataatggcgtctttcagattgagccgctcttttaatgtcttttccaaaagcgtcaatcctaaaacatccttcatcgtatcttccagaatcgaaagcagtgaatagccctcttccgtcattgtcatgccgtttgttttaatatcgatgagattttgttcttttaagaactgaacctcgcttctgagaacgcgctcggtcaatccgagactggctgcaagacttctgcggccgatcggttctgtaagcctgatatactgcaagatttcaaatcttttctgcatcacaagcaaaagatcaggcaataattttttttgagcttgtattaactggttcatgactcaaacgttccttcctattcatactggacagaaaatgtcccgctatgacaaaaaacgtcccatcatagccaaaaaaaattatgtctgctttctttaattattttaacaggatgacattgttaattcaactgttaaaggtcaattcctcgacattcttcgcaggatttaccagtatctccttgatacagtcattatatacagaaacggaatgaaggtgacagacaaaagcccgccgcagcggacttttgccgtaaaacgctttcattttatccagagtttttctatttcttctaatgatttatttttcgtctcggggcagatcgtcacgacaaacaagaaacagagaatattaatgacggcgaatatccagaaggtgtacgcgagccccaacccgctgatcatcatcggcacgaactggccgatcgcccagttggcccccataagaatatcgtcgcaataccggcggcgcgtgcgcggaggtggttcggaaagatttccgaaatcatgatccacgtaatcggcccgactgatacgcagaaagcggcgacgaatcccaatatgatgacgactaaagccggaccgctcgccagctgaaaataaaaggatgccccgattaagatcatgaacagcgccataaaggcagatccgacccccatcagctttttccggcctaccttatcgactaaaagaaccgcgataatggtgaaaatcacttcaacgacaccgacgatgcatgtcgtgataaaccccgcattttgtccgaagcccatcattttgaaaatttccggcccgtaatacgtaattgcgttcatgccgatgacctgattgaataaagccagcagaatcccgatcacaagcgcttttctcagccccggtttaaacagctgagacaatgaacccattttttctaattgtaaagacgtttcgatttgtttgatttcttctttcgcggtctgctcgccattaatgcgcgtcagcacggtgagggcttcattccggcgccccgctttcgcaagccagcgcggactttccggcacgataagcagcacgataaaaaagatgacggacggaatcatgccgtaagcgagcatccaccgccagccggtgtgcaccccccattcatacgagccggactgctggacggcaaggttaataaaataagtgccggagatccctaatatcgtaaacagctgatacagtgaggaaagactgccgcgtatggccggcggagcggcttcggtaatatacgtgacagaaagcgaggagcccatgccgattcccagaccgccgatgactctggcgatcactaaggaagacacactttgagaaagcgcagagacaaccgctgacaccgcaaacaacagcgccgctgccatcaatatctttctccgtccgaaccggtcacttaaaaatccggaaattccgacgccgaaaacaccgccgatcataatacttgaaatcacgagcccttccataaaaggacttaagcggtacaaatctttcaggaaaccgatggcgccggaaatcaccgccgtatcataaccgtacaaaagccctcccagtccggccgcgcatgagatgagaatgacaaaccacttcgaatgctgccgagtgacaggtacatttgagccaattggtgccgggtgattcttcatgaattttaccctcccgcgaataatagaataaaaacgcttacaaaacaaagtgcggcgcttgagttgctttgttttcttcagaaccgccacatttgtacgtacttataaagaattttatctaaaaataaggaaaattagtacgtacaaataaagaataagcagtttttcacaatctgtcaattatttttacagcttgatgaaagggcttactatgttatactggaatttgtccgtatacattttggaggaattgatatgctaccgaaatatgctcaagtaaaagaagaaatttgttcatggctgaatcagggaaaaatacagccggacgaaaagctgcctacggaaaatgagctgatgcagcagttcggggtcagccgccataccatcagaaaggcgatcggagatttggtctcgcaggggttgctgtacagcgttcagggcggaggcacctttgtcgcttcacgcacggcgaaatcagccatgcattcaaacaaaacgatcggtgtcattacaacgtacatatcagactatattttcccgagcatcatcaggggaattgaatcttatttaagcgaacagggctattccatgctgctgacgagcaccaacaacaatacagaaagtgagcggcggggccttgaaaacctgctgtccaaaaatatagacgggctgattgtcgagcctacgaaaagcgcgctgcagacgcccaacatcggctactatctcaacctggagaaaaacggcattccgtttgccatgattaacgcctcttatgcggagctggccgcaccgagcttttccgtcaatgatgtcaaaggcggcatgatggcttgcgaatacgtcatgtccctcggccacacgcacattatgggaatctttaaagcggatgacacgcagggcgtcaaacggatgaacggctatcttcaggcgcaccgggagcgcgggatttttccgtctccggacatgatcgtgacttacacgactgaagaaaaagaaaccgtgcttcttcaaaaaattaagcatacccttgagcaaaacagcggatcatacccgacggccattctttgttataatgatgaaattgcgctgaagacgattaatcttctcagagaattcggcttaaaggtgcctgatgacgtgtcaatcatgggctatgatgattcacatttcgcccagatttccgaggtgaagctcacctctgtcaagcatccgaaatccattatggggaaagcggcggcaaaatacgtcatcggctgcttagagcataaaaaaccgaagaaggatgacgtcgtgtatgaaccggaactcgtcatccgaaattccgtcaggcggatcggcgaataaaaaaagcaatgtgcgcggcacattgctttttttgctcagctgttttttaattcggcgatgatctcaaatgatctcattctgtcggcatgctcaaagctttctgaattcaccatgatttcatccgcctgtgttgtccggatgaagctttccagcttttccttcacacgctccggtccgccgacgatcgttgaactgagctgttcattgaccatcgctttttcatacggcgaccagatttgatccatgtcttcaacaggaggcttcagctggttcggcgtgccgcggacgaggtctaaaaatctttgataatgcgatgtcgccagatgctccgccttttcatccgtatcggcggcaatgacggtgacgccgaccatcgcgtacggttgatccagtacgtctgacggacggaaggagcttcggtacagctcaagggcgggcacggtgtttttcggtgagaagtgagccgcaaaggcgaacggaagcccgagctctcccgcaagacgcgcgctgaagccgctcgatcccaaaagccagatcggcacgtccagcccttcgcccggaatggcgcggacttgattgcgcacattgcctgagggtttgaagtaatttctcaattcttcaagctgctccgggaaatcctccccgctgtttatgtttcttcttaaggccctcgccgttaattggtcggtacccggcgcacgcccgagtccgaggtcaatccgccccggatataacgtttcaagggttccgaattgctccgcgattataagtgacgaatgattcggcagcataatgcccccagaaccgacgcggatttttttcgtgccgccggcgatgtggccgatcagcaccgccgttgccgagctggcgacaccttctatattatgatgctccgccagccaatagcggttatagccccactcctcggcgcggtgcgctaaatccatgctgttgcggaacgattcagcaaccgttcccccctgtacgaccggcgataaattcaatacggaaaacgcagtatctttcaatgtatgttcagccatcgttttctcctttatggtttagtgtaagcagatcttaaacaaggtctctaccacacaccttaccacagcttttcccgtgagttaaacaatttgattcgatgatcttcgaacaatcagtcagcggtcgtcactagtgaactctgtatgaatgaatctattacattcagatatgaagagcctagaatgatataaaaatgaaaagatatcattgaaagaacagaaccaataatgttaacatatgtcatatattgaataggaaggaagtcatagtctatatgcgtaaaaaaatcttaatggcactcacaacagctttactggcagcaatcttctttaccggaaacaccgataaggcatatgccgcagacttttattccggcactcagcagcatttaaatgtaagcggatttaccgatgcctcctactacacgaaaaaagcgaaaagtgtcgattttactctcagtacagcgtatccgtcagatcgaacctttaaaggaaacctatacttacagcgaaagtccggaaagaaatggacgacttgcaaaaaaacaaccttttctttctcagtaagggtgactaagtcattctctttaaaaggatgcaagacaggttattatcgtgtcaaagctacgttcagcggttcaaaacttgtcaatacgacaaactcttttaaaattaaccgataagattcagggccctaagatcattagggcctttttattcattctttgtgagctcctgcgcgatttgaataaaaagttttgccgccaatgaagcctcttttacagaaggaacggcaagcagaacatcacggtacaccgcctgattgagttcccttgtcacgacattttccggcagtgatattccggacatagacatttgtgataatatcgcaattcccagcccctctttgatcatgctgatggacgtattgacgttgtaaacagtgaatgcggcagtcagcacagaccctgcctccttaaacatatcaataaacggtgattcgtatcctccgtcacagatgatcatcggctggcggtcaagatctttcagagtaattgactcacagctgcaaagcggatgatcatttctaagcacgacggccattttatcttttttcagcggcagatattccatgtcttccgtaggaaaaagagtgatccccacatctattacccgggagcggagccattcctttacttcgttaaccgttccttcataaagcaccaactcaagtttcggataccgttttttaaacacgctgatcagttttggaatgaaataagcggaagcggccggaaatgtgccgatgtgaatcgttccctgttcaagccctctttccgcggccgccagctgctcggctttttctatgcctttgagcacctctctgatatgaacgagaatttttccgcccgtgtccgtgagccttacgccgttgcggcgctcgcggatgatcagcttgatgccgagctctgactcaagcgccgagatggcatggcttacggcgggctgtgtcatattcagcgcctgccccgcttttgtaaagcttcccgtttcagcgatttgaacaaaaacccgcagttgtgtaatcgtcataacgttttacttatgctccttataaaaaagattcattttatttatcttactgattaccgtatcatatgatggaattgttctacaaggagtgaacgacgtgaaacagctttcgaaaatacagacggctcttatgctggcgtttctagtcacggtatggggaattaactggccgctgacaaaagccgcgctcgcctattcgccgcctcttctgtttgccggaatccgcacgctgatcggcggacttctattattaatggtggcgctgccccgttttaaaaagctgcgttttaaagaaacgtggccgatctatcttatttctgccattttaaatattactttattttacggcctgcaaacggtcggcttgaattacctgcatgccggcttattttcagccatcgtgtttttccagccggtgttaatgggcgttttttcttggctgtggctcggggaatcgatgtatcctttaaaaatagccggtcttattctgggctttgccggtgtcgccgtcatcagcgcagccggtttcggaggccatatttccatcgccggcattcttttggctctgggctccgcggtcagctgggcgctcggcacggtatatgtgaaaagaacgggcggacgcgcggactctatctggatggtcgctcttcagcttctgatcggcggcgtgctgcttgtcagctccggccatttttcagaaagcttttcagcgattcaatggaaaactccgttcattctcagccttctgttcatttcggtatttgtcatcgcactcggctggctcgccttttttacgcttgtcggttcaggggaagcaagcaaggttgcctcttacaccttcctgatcccgctcatatccattgtcgtcagctcgatatttctgcatgagccgctgaccgtcagccttttagccggactgcttctgatcgtcacaagcatttgttttgtgaatataacaccgaagaaactgaaaacacctgctctggccgcagaaaaaaaggccgttcattaaaaaaactcttgccgcggggcaagagtttttttatttattgacgtctccctttcacgagatacgcagccgtaatgagcaggtagatggccgcagtgatgcatgtgatgacgatggacgtcgtcgcaattacgccgatcaggatggccaaaagcgcaagcaccgcgaaccatgtcgtgtacgggaaccatttgacgtaataagccggctgttctgttgaatgttttcttgattttaaatgggcgaatccgataatcagccagatgaacagcacggtatagccgagggaacccatcaaataattaaacgtccggcttcctgcgaataaagaaatcaggacgcctacatataaaaatgacgtacaagtcagaatcgcatagacaggaacctttttcttcgatagttttgaaaagattttcggcacccggccgtcagaagcctgcgtaaataagacgcgggatgatccgtacagtcccgagttcatagacgagataatcgcaagaagaatgacggcattcataatatggtcggcacccggaattccgatcatcttaaatactatgacaaacgggctttcgggaacgctgttgacttgattccaaggaatcaggctgacgatgatgaaaaacggcagcaagtaaaaagcgacaatccgcgttaacgtgcttcggacagctttcggaatcaccttttcggggttttttgtctccgccagcgtgacgccgatgatttccgttccgccgtatgagtagatcacgacgagcatcgccgtaatgacgccccccgctccatgcgggaaaaaccctccgtgatccgttaaatgagacagccccggcgccgtgtgattgccgaatgagaaaaataatagcagaattccgcataaaataaagatgacaatcaccgtaattttaatgagcgcgagccagtactccgtctcggcaaacagtttcacagaaagcatgtttacgaccgtcaccacgatggaaatgatcaaagccagtatccatatcggacattccggcagccaatattgaatgaaaatggcggctacgaccgcctccgcggcaatattgagcacccacattttccaatagatccagtctaaaaagtatgcagcgtacgaaccgagagactgctgaaccaaatcacggaacgtccttgcatgtttgtttctgacggccatttcggccagcccctgcataataaacagcagaatgattccgccgaggaggtaggccaacagcacggacggccccgcttcatcaatcgccgtgctgctgcctttaaagagcccggccccgattgcgcctccaagcgccatcatcataatgtgtctggacgacatcgtccgttttaacgtttgcttgtccttttccatctatcacacgccctctcgcaaaaagtgttcatcacataaaaaagcacgccgcctctttaggaaaagagacggcgtgcctcaggcagccgcggtaccactcttgttgatcccgaatatccggaatccagcttaaaaaccttttaacgaaggtcagccgttaggacatagggaatattccgacaattccgttccgccctgccacttccgggcgagttcaaagaacaatcagtccgcgtttcaccaacccgcggctctctttttctgactggattctcttactgctcccgttcacagtgttttatgttaaatgaatctcttgagtttttattttctgaatatagtaacataatatacagtcttctattttcaaagtcaatactaattttttccgtctattgtccttcccggtgattcggaaatttcagctgaaatccggacacaaggctttgctttccggcgccatgctttccgctttcacctttgtgtttgcgtataaaaacagcgcaagcgcaatgccgaatgatatgacgagaatccatgcttttttcattcagatgcctcctcactttctatcatcggcggctttttctctttttttacacacaaaattgaaaaaacaattttaaaattctgttttccttatattgaaacttgctttatcataaaagtatgcgtttacattcgagtagggaggttatagtatgacccctgtgaattcaagcagcatcgggaagattcaggcggccagcaaaggtttgtcgccaaaattgagagcgattgcagaccatatcgtgaaggaaccgaaagacgtggttcacctttccatcattcagctggccgaaaaaacgaaaagctctgaagcgacgattttcaggctgtgcaagcggctcggtttttccggctatcaggatttaaaaatcgcgctggctcaggagatcgttcaggagccggtgcagcacattcatgaagaaatgagccccgacgacgatatcgaagtcatcatccggaaagttttccgcacaaacatttccggtctgaccgatacctttcaattattagatccggccgacgttgaaaaagcggtagaaatgatccaccgcgcagacagaatcgaattttacggaaacggcggttccgggctgatcgccactgacgcgtatcataaatttatgcgtacgggtataaattgcatcgcgcatacggattctcactttcaggcgatgtcagcgggtcttctcggtcctgaaagcgcagtcatcggcatttctcattcggggagcaacaaggacgtgctcgacgcggtcaaaacggccaaatcgctcggcgccggcacgatcggcattacaagctaccaaaagtcgccgctcacccagatttccgacgttgtgctgtatacatcaacaagggagacggctttcagaacggaggcgatgtccgcaaggcttgcccagctgtcggtcattgatacactgtatttcgccacggcccggctgcggcaggagaaaacgctcgccaacttgcagcaaatcagaaaaatgatcgcgcacaaacgtttgtaatcgttttctaaatatttttttcaaaagagagaaagccgatacagcgggaattgaggcaattttatgaaaaaatttttcttcttcatcgttgatttataaaaaaattattcctataattgactttgtaagggcatacattataaatctatcttattattcaatcagattaggcgggatatattatgaaggaaacccaagctgttatcggtctggatatcggcacgaccagtacgaaagctgttctgttcggaccaagaggcaaagtgttagccaagcattcggttcactatgatttaatacagccaaagccggcatgggccgagcaggatcctgagcacattttggaagcggtgatcggaagcatcaggggcgccgtcacaaaggccggactgagtcctgacaatctgcttgcaatcggcatcagcaccgccatgcactcattgatagctgtcgatcaaaacggcggcctgctgaccaaaagcatcatttgggcggacaaccgcagcgccgagcaatcaaaacggattttaaaagagatgaacggttttgatatttataaaagaacgggtacgccgattcatccgatgtctccgctttccaaaattgtgtggatgaaagaacaggacaaggagacattcgcgaaaaccgccaaattcatcagtattaaagaatatattctgcacgagtttttcggaacttatgtcgtcgattattcgatcgcttcggcaacgggactgttccgattagatacgctttcctgggatgaagaagcgctcaggattgccggaatccgggaagatcagctgtcggacattgtgccgaccactcatcagctgcgcggccttgcgccggaaatcgctgcacggatgggcatccatgcggatacaccgtttattatcggcgcaaatgacggcgtgctcgccaacctgggagtcggcgcgatcggcaaaggcgaagtggccgttacgatcggaacaagcggagccgtgcgttcggtgacggatgcgccgattacggatgaaaaagcgcggacattctgttacgcgctgactgacaagcattgggtcatcggaggcccgacgaataacggaggcattatgctgcgctggcttcgagacgaattcgcttctccggaagttgaaacggcgaagcggctcggcattgatccgtacgatttaatgattgatattgctgataaagtgcccgcaggctctgagggattgctgtttctgccgtttttatcaggggagcgcgcgccgttttggaacccgaatgcccgcggaacgtttttcggcatcagcctccgccataaacgggagcattttatcagagcggtgctggaaggcgtcatcatgagcgtcttttcaatcggtgtcgcactgagagatttggcgggccccgcaaaagacgtgcgggcttcgggaggatttgcgagatcgccgctgtggaggcagattttgtccgatacgatgggacgcgaagtcctcgttccggaaagttacgaagcctctgcgctcggagcggccgttctcgctttgcacagccttggcgaaatggaacggatcgaggatgttcaggactggatcagaatttcgcaccgccatgaaccgaacgtcaaaaacagcgaaacatatattgagctgttttacttatacgagcggctgtatgacaagctcaaagatgaatttgacgtcatcagtgaatttcagctcaaacaaagccgttaattcttctttgaaagaaagggtgaaaaggtcatgttactgtttattgtcattgccgctattatcgttttactcttattgattacggtcgctaaattaaatccgtttatcagtcttttgattacatccatccttgtcggtttcgcaacgggcatgaatctgccggacattatcacttcaatgaaaaccgggctcggcaatacgctgtctctgcttgcgatcgtgctggccctcggtacgatgctcggaaaaatgatggctgaatcaggcggtgcggagcggatcgcccacaccctgatcggccgcttcggcaaaaagaaagtgcattgggcgatgatggccgtcgcttttattgtcggcatcccggtctttttccaggtcggcttcgtcctgctcgtgccgcttttgtttacgattgcgattgaaaccggggtttcattagtgacgatcgggattccgctccttgcgggactttccgtcgtgcacggattggttccgccccacccggcggcgatggcggctgtcggcatttatcacgccaatgtcggaaaaacgattttgtattctttaatcgtcggtattccgactgccatcatcgcggggccgctttacggaaaatggattggtaagcgcattcataaacccgttcccgaactgttgaaaaaacaatttattgaacggaatgaaaaacgcaagcttccgggattcgcaaatacattgtttacgatattggtaccggtgatcctgatgcttatggcaacgcttgccgaaattgcgcttccggaaaaaagcacgctctatgaaacttttaaatttatcggcgaccctgtcacggcgcttttgatcgccacggtttactcctttttcagccttggtttttatcagggctttgacagggaaagcattttaaaattcagcaatgactgtctgggaccgatcgcttccattctgcttgtgatcggagccggcggcgcttttaacaacgtcctgattgattcaggcgtcggcacgtatatcgctgacatggcgaagcactcaagcttctctcccgttcttttaagctggacgatcgcggcggtcatccgtgtcgccacaggttcagcgactgtcgccatgatgacggcggccggcattgttgctccgattgcatctgtcatgccgggcgtcagcagcgagcttctcgttttggcaacgggagcgggctctttgattctgtcacatgtcaatgactccggtttctggctcattaaagagtatttcggaatgacggtaaaagaaacgttcctgacatggacggcgatggaaacgattatttctgtcagtgcgatctgttttatcatgatcattaacgcgtttatataaaaacaaaccccggccgcaaaccggggtttgtttttttatcggtcattcacgaggatataagcggctttaacgggtccgtggacgccgacaaccaaatccatttcgatatcggccgagttgctcggtccggtaatatagttgatgcaggaaggaacggtgacgccgtctctgatctgctgtttcagtatatcgctggcctgtgtcattctcggcacaatggaagatttcgggatgattgcgatataggtggtcggaagcaggctgacggaacggccggcatgctctgacgcatacaaaacgacggtggctgattccgcaagcgtgatctcgctgaatgtgatgcccacattcgcttgttccgctttttcaatatttttcgctccttgttccgcgtcccattcccaaacgggaatcccttcgtccggccactcttctgtcataagggtctgcaagccgtacatttcaaaccggctgtcgttcggaatgatgacaggccccccttcaaagcggttcacctgcgtgcgcaaagcgtcgtaaagcccggctgcatccgtttcgatcagttcggtatgaatgttgacgcagtggtctttcagcatcgtgacaagatcgtcttccgtacagtccgcatgcgtttgatattgaggctgatacttccattcaggcagggacacgcctgatttcctgcgctctctgcccagacttccggcgatccggtttagaaaggattcctgatgtgtaaccgtccctttcatcatcattcttcccccttttgtttttcccggtctttaaaccaatctctgaatctcgatttatgcggcgccgggaagtcccgtattgccgtccattcttttaacggccccggcccttttgatattttgtcatcctccgtaaacggcgtcatggcggcaggcgcccatttcgatcccagtttataaagggacggggatgacgagccgagcccgaaggctttcatcgccagtttttcgctgatcggcgctttgccctctttttccacaatgttctgccgatgcttgagcagcagctcgtgcagcggaattttaaccggacacgcttccgtacaggccgcgcataaggaagatgcgtacgggagctccttgtattcgtcatatccgccgagaagaggcgataagacggcgccgatcggacccgaatagatggacccgtacgagtgtccgccgacatgccggtacacgggacagacgttgatgcaggcggcgcagcggatacattgcagcaccgattggaattccgtgccgagtatgcgggaacgcccgttatccacaaccacgagatgaaattcctcaggcccgtcagcttctccttgctgccgggggcccgtcagcgccgtaatgtaacttgtaagccgctggccgaccgcgcttctcgtcagcatgctgacaagcacttcaaactcagaaaatgaaggaacgatccgctccattcccatcacggtgatctgcgtcttcggcagcgcggacacaaggcggccgtttccttcgtttgtcacgagactgaccgatccggtatccgcgattgcaaagttgcagcccgtgatgccgacatccgcttcgagaaattttttccggagaacgctgcgcgcgtgcatgacgagctcttccggtttttccgtctgtttgtattcgagtctctctttaaacacgtcacggatctgctctttgtttttgtgaagagcgggagcaacgatatgtgacggcggatcgtgatcgtcaatctggagaatgtattcgccgagatccgtttctgtgacttcacagccctcttcctcaagcacttcgttcatattgatttcttctgtcaccatggatttggattttacgatttttttggcgtttttctgccggatgacatcgcggatataggaggacgcttcttccgccgtttcggcgaaaaagacatgcccgcctctgttggcgacgttttcggcgagctgttccaaatagaaatcaagattgtccagcacatgctgtctgatttcttccgcatgtgaacgccaatcctcccagtttcccaattcctcggccgcctgaagcctccttatcctgagccgttcctgcgctccggagacggctcctctcataaactcattatctattccttctgatacccgctctttaaaagcggcggtaccgattttcatcgccatgattttacccccttgttgtttctcgtcttatctgctgttcagcacttctgcgatgtgcatgactctgacgtttttatccttacggtcaagacgcccgccgatattcatcagacatccgcaatccgccccgatcagcacctcggcctccgtgtcttccacgcaggcgaccttttcatccaccatttgttcagagatttgcgccattttcacagaaaatgttcctccgaatccgcagcattggtgttttccgggaagcgcggtcagctcgagccccttgacatggcgcaaaagcttcatcggctcctccgacacgccgagcagcctcgtcatgtggcacgatgtatggactgtcgcttttttatgcagcaccgccccgacatcctccaccccgagaacgttgacgataaaatccgttaactcatatgttttgtccgcaagctgctgcgcttttgcggcccacttcggatcgtcctgaaacagatgcggatattcacggaacatcgtcgtacaggaacctgacgggctgacgacgtactccgcttcttcaaacgcggcaatcatccgcttcattgcttttttcgcatccgtcacatacccgctgttgtatgcgggctgcccgcagcaaatctgcccctcgggaaaatccacctcacacccgagccgttccagcacctcaaccgtcgcctttccgacattggtctgaaacatatccacaaggcacgtgacaaataatgagactttcatgatgaacccctctttcatcctcagtatgtgatccggtcatctgatgacctgtttttggaaagctctataaatatcctacactattctgaatatggattggaaggtttttctgaaaaatcctttcgcccgatgcgctgaagggtaaaaaaaagagaagcctgaaagcttcccatgcttctctagatcccgtttttcagcaggtgtcccagtttttgcacaccctcttttatcgcggctttaccgggaaaactgaacgacaggcggagatattcggcaccgtcttcctgatgcggaaaaaaatattttccgggtacataggaaacgccgtgagacagagccctcgccagcagtgcggacgtatcagcccccggcgctttcacccatacaaagtaaccgccttcaggcacgtgccaggatgcggattccggaagatatcgcgctgatgcggcgagcaaaacatcacgtttgcttcgatatgcttcccgcaaggcggcgagccgttcttcaatattcgtttgttccagatagacggcggtcaccgcttgggaaaacggatggcctaagtctttttttaaccatgacaatgccgtgatgaatgcggcgtcccctgcaatccagccgatcctcatacccggggcgatgacttttgataatgaaccggcgtacagcacccggccgttttgatccatggctttcaagggcggcggaatatcggtgaatccgagctcgccgtatgcatcatcctccaagatgagaaaatcatacgtttcggcaagctgaagcaggcgggttctccgcttcgatgacattacggttcccgccggattctgaaaagcgggtatcgtgtagagaagacggggaagcacaagcccttttcgttttctttcctcaagcataaacgctaatgtttctgtttgcagaccctcttgatctgtcggaatgctcatgatatgcggtgtataatttttaaaaatctcgagcgcttccatatagaccggagcttcaacggcagcggcggtttgttcatcgaggaaaacccgcgcagccagatctatcgcctgacaggcgcctgatgtcacgatcagctcatcgtcccggcagtgaatgccgcggatggctaaccgttcttgaatctgcttttttaaaacggccgtcctcgggcttcctatataatgcagcggcagatcacgctcctcatccagaaggcgggaggcggcttctttcagctccttatcaggaacgagcgcgggatcgggatagccggaatgcagagggatgcacgctttcggaactgccggcatccattccccgggaggatcatttgtcagagctttctttacatggtcagaaaaaaaagattcggcctgcatgtgatgttatcccctttcacaagtcagcttctatacattttcttcaaaataagcccccagcacttcttccacattcgtcaggtgcgccgtcatcgctgcttccgcttcatccgtgtctccggcggcgacggcgctgtaaatgcgttcatgctcttcatacaatcgctgcacgctcgttcgtttagaaaacagccaaatttttctcgtttctctcattgtttccaaaaggagcgcggagacatgattcatgagatgcttaagcagcccgttttgtgatgcttccgccagcgccatgtgaaaggagaaatctgctttttcgcccaattcttcgtctccgtcaatgtctttcatctccatgagagcttggcggattttttgtaaatcgtcttcggtgcgtttttcagcggccatggcggcgacgccgagttcaagcagctttctgacttcgagcagctgtttgacgtcctcttttttcatcaagagggcggaagaaagcggctgggaaacatgagacggctcaaattctcttatgtatgtgccttctccctgcttcatgtcgacgagccccatcgctttcaaagccgacagcgcttctctgaccgccgagcggctgacctgaaaactctcggaaagcgcctgaacagaatcaagcttttcccccggcttaagctcgcccgcttttatcttctccagcaatgcgtcagcgacttcctcgtagatttttttcgttttaatttgtttatatttcaacgcgatcaccccgtcacttgtgaatcttgatgtttatcgtctattatacttctttttttgtgtagccgacaggttcagacaatttgttcaagaaaagtattgtactttcaaaactttcaaaatataatgctaattaacccggtcatcagatgaccttatcataaaaagtaatcgtttacatgacataaggaggggttttttagggatgcaatggacacaggggtacgctcctttagggggaaatttgcttttatcggcagcttgcgcgctcgtgccgattatcttctttttttgggcgcttgcggtgaaacggatgaaggggtacatagcggggcttttaacgttagccgtttcacttttaatcgctgtatttgtttacggcatgccggcggaaaaagcggtgatgtccgcttctcagggagcggtgtacgggctgcttccgatcggctggattatcgtcacatcggtctttctgtataaaatcaccgtgaaaacgggacagtttgagattatccggagttcggtgctctcaattacagatgaccggcgtttgcaggcgctgctcatcgccttttcattcggggcatttttagaaggcgccgccggtttcggcgctcccgtcgcgatctcggccgctttgctcgtcggacttggttttcagccgctgtatgcggcgggaatttgcctgattgccaatacggcgcccgttgccttcggtgcgatcggcattccgattaccgccgtcgaaggtccgaccgggataccggcaatggaaatttcccaaatggtcggccggcagcttccttttttatccgtctttattccgctttacttaatcattttgatgagcgggtttaaaaaggcttttgaagtatggccggccattcttgtttccggcgtctcctttgcggccgtgcagtacgcaagctcgaattttttagggcctgagcttccggatgtgctgtcggcgcttgtttccatggccgcgctcgctgtatttttgaaattttggaaaccgaaaacggcctttcgtttcgcggcagaacgggaatcagcagcggccgctgaccgggcgccgatcaagtacgggggcgccgcggtgtttaaagcgtggtctcctttccttcttctgacggccatgatatccgtttgggggattcccggcgtgaaggctgctttaaccggtcattatgaaggaacgtcaatgtggctttcctggctgaatgcagccgggaaagcattgaccttcacgcctcccgtcccatttgtaaatcagcagattcttcaggcggacggcacgccgattgaagccgtgtacaaacttgagcttttcggttcagcgggaacggcgattctgattgccgccgtcatctccaagttcgccctcggcatgtcgtggaagacgtggggcgaagcgtttatagaaacggtgaaagagttaacgcttccggtcgtgaccattgtttctgttgtcggctttgcatatgtgacgaatgcttccggcatgagcacgacactcggtcttgcgcttgccatgacgggcgcgatgtttacctttttttcgccggtgctcggctggctcggcgtatttattaccggctctgatacatcggccaacctattgttcggcggattgcaaaaggtgacggcgctatctgtcgggatggacccggttctctccgttgccgccaattcatcaggcggtgtcaccggaaaaatgatttctccgcaatccattgcggttgcctgtgccgctgtcggtctggcgggcaaggaagccgaccttttccgctttacgattaagcacagtctgtttttgcttctgctcgtctgtctcattacatttttacagcatcatctgttttcatggatgatcccgtaacacggagaacctccccggggtttggctcggggaggtttcagctgtaccgttttctcgccgatgacggcggaatatttaattggtcacggtatttggcgacggtgcgccttgagattcggatgtcatattgttcatgcagcagatcggcaagcttttggtctgaaaaaggtttctttttatcttctttacggaccaatgcttccagatgcgcttttacggcataattggaggcgccgccgtcccccgatgattcagctttcgccgagaaaaatgttttcatttcatacagtccgtacggcgtctgaacgtacttccctttgatggcccggctgatcgttgattcgtggagctccagcgtttccgccacctctcttaaggtcagcggctgcattccgctttttcctgtgagaaaaaaggattcctgccgttcagtcaggacgccgataattctcgtgatcgtttgttttctttgcgacaaagcccggttcagccagcgccattcctgatattttgccgacagataatttttcgtgtcacggcacccggcggctgacaagagcggctgataatgggcatgaagctggatgtcaggaaacgaacggctgttgagccgcgcttgaatgatgccgtttttcaccgtgatgaaaatatccggttctacgtaaaaacccggctcctcatgcgcataacggagccccggcctcggatcaagcgcgctgatcatgtcagcgatgtcctgaatgtctttaagcggaatgcccgttttaagtgtaagcgctttccaattctttcttgcaaatagctcaaaataggcttcggcaatccattccgcctgttcgttccgctcgggcagacggcggagctgaagaaggatgcattcctgcaaagaccgggcgccgattcccgcgggctcaagggattgaagctttttcagaaccgcttccgtctcctcttgtgaagcggatacatggtcggcggcggctggtatgtcctcttttaaataaccgtttgaatccaatgaatgtatcagataattgaaaatttttttctcatcatcggacagcttcatgtctaaggcttgctgtttgagcgaatcctgcagcgttttgcgggtaagtctgatctgctggcttccgtcccgttctttcatcctgtttttatttgttttatggtaagatagtggcggcgtgtctgtttcctttcgttcaatcagagggttttccagtgagagctcatcaatatatccggccagttccgcggaattgtatccgagtaatgtgatggcctgtttaagctcttgcgttaattgaggctttaacatttgtgtttgctgaagtttgatatccatcatgctcactccccttttttcattgtacatgattggtttcataccgtatatacttattaaaaggagttgctttatagatgtcagaacttttttctgttccctattttattgaaaactttacacagcacattgaaatgaatccgaatgaagaccgaattcatgcgatgaacagctattaccgctccgtcgtctcaacccttgtacaggatcagctgacgaaaaactcggttgtgctcaaaagaattcagcatttggatgaggcgtacaacaaagtaaaacgcggagaaacaaaataaaccttccgctcattcaaagcggaaggttttccttcgtgccggcggtttcaccgatcagccggacgtccggcgcttcgtgcgtccaggtgtaataatagttcgcgtttttcccgtatgaattatcaatgacggtattcggtttcccgagaagcgaggacaggatgtggccgtggagccttgacgtttccaccgattcgtacctgctgaaaaacaggaccgcttttttcgttaagaaatcggaatagcggttccaaaaccgcgcaatcggcagcgggtttcccgcttttttattcaaaacattcagcgtttggaaaaaagcgattcccctgcggtcgcttgctgacagaacatcctgccagtcacagcttttaacggaagaattgttttgcagcttcgggttgatttccccatccgtgcggataaaataaagcctgccgcgtgacggaaccgctgacgccgcgatcggatacagctgatgggccatatcaggcataagcccgatatgattcgccgaaaaaaagcgtttcgcagtctcgtatgacacatgatctctcgtaaacaggtggagatccttgtgctccgcaaaaagcgccgatgtcttttgcagccgtgtctcatcctgataataaatcgattgcggcaggatgacgatcctgttttccggaaaggatttgacgattttttccctgaacgtctgatagtacggatagagatccccgaaatttccgccaccctgacagacgatgatcgtctttttgtccgcccggcgcccgaatggaaaattgtcgggattccagcgctgtttcacgcggatgccgtgcgctttaaaaaacgcctccgtccctttcataatcaataaatcccctacatttccgtagaggggatagtcggcatatatgatgtcggattgcggcggtataacgctgagcagacccgtcagcgtctcttttaatcggctcataacatggcggctgtccatgttttctcccctttcgtttcaaacagttgcgcaagtgcgtcaatgacacgctgctgctcctcagaagacaggtcagacccggacggcagacaaatccctcggctgaaaaggttctcagagacacgctcatggtcgctgtgaggataaaagacggaagatgagaaaagcggctgcgtgtgcagcggtttccacagcggccgggcctcaatattctgttccgcaagacaggcgacggcttcttccggcgtcacgccgttatcaagcgtcagagccgtcagccagcggtttgaaaccgttccttcaagctccggcatcatgcggatgcccggatatgtttcgagcgcttcccgataccggtgaaagatttctctcctcgcccggacgcgatcttcaagcacttccagctgcgatatccccacgcccgcgagaatgttgctgagcctgtagttgtaaccgagctcgctgtgctggtaatgaacggcggcatctctcgcctgtgacgcaagaaacctcgctttttcaatcgcggcttcatcgtcagacacgagcatgccgcctcccgatgttgtaatgattttgttgccgttaaaggaataaatgccgaaacggccgaacgtgccgctctgcctgcctttatatgttgatcctaaggactcggcagcgtcttcaatcagacagacgccgtatgcgtcacaaaggctcattaattcatccattttcgcgctttggccgtaaagattgacggcgatcaccgctttcgggagtctgccgcgccgctttgcatcccggagcgcccgctcaagcgcagcgggcgacatattccacgtctcccattccgaatcaataaaaacgggctcagcctgctcatacacaatcggattcgccgtggcgacaaacgtaaaggaaggacaaaatacaacgtctccttttttcacacccgcaagccgcagggcaagatggatggcggccgttcccgagcttaaggccgccgcgcttttcactcccgcatattccgcgagccgcgcttcaaacgaattgacgagcggaccgagcggggcaatccaattggttcggaaggcttctgcgatgtattcctgttcttttccgctcatatgaggcggagacaaataaatccgtttgtttgtttgcatgaaatcatcctttttcattatggataggggagatgacgcgggccggaacgccgaccgccgtcacatggccgggaattctgctgatgaccgcagcccccgcgccgataacggaccaagggccgatgtccatctgcggtatgacggacgcgccgattccgatgtgcgttccttccccgactttcactccgccggcaagcgccgcgcgcggtgaaagatggacgtaatctccgattgcattgtcgtgatcggcaaccgcccccgtattgatgatgcaatgggcgccgatgtcagcgcccgcctgaatgacggcgcccgccatcacaaccgttccgtgtccgacggaagccgtttcactgacgatcgccccggggtgaatgagtgaagcataatcggcagcttcaatcccaagcgtttcagcgaactgctttctgacgccgttgcggccgatgcatatcgtgaacacggcctcggggacgagtttccgaagcatgtgcacgtcttccgtccggcccgtatataaaccgttccgagcggtaaaaccgctgaatccgtcgtccaatatgcccgcaagctccatatcggaacgggcctgcacgatttccttcacgacttttccgtgtccgccgtttccgatcagcacgacctttttcacgatgacatatctccgctgcctgtgaagcgctttgccgtcacatggccggcttggtgtatgccttctgacacgagaacttttttcactgttaaaagcagaatctttaagtcgagaagaaaggtgcggttgtcgacgtaccacacgtcgagcttgaatttctcctcccatgaaatcgcgtttctcccattgacctgcgcccagcccgtaatccccggcttcacctcgtgccgccgcgcctgctccgccgtgtaaagcggcagataatccatcagcaaagggcgggggccgaccagactgatatcgcctttgagcacattaaaaagctggggaagctcgtcgatgctcagttttctgatcagccttcccgttttggtcaggcgcagatgatccggaagcagcacaccgttttcatcacgcgcatccgtcatcgttctgagtttatacaacgtaaacggacgcccgttatgccccggtctcgtctgtttgaacaataccggagacccgatggcgcatctgacggctgccatggcgaagagaagaatgacactcgcgccgcacaataacagcgtcgcggccgctatatcaaatacacgtttcaccttcaaatctgaacagctcctttcacttttcggcatttctgtaaagcaagccgcctttcttctttcgtacaaatgaagaaaaaagcgaatgcggcatagcttatgcatacggcaagccccgcggcgatcagaccggcccagccgtcaagcggtgaaaacagccggataccccggcagacggcccaggcaaatacggccgccgccaacgggccgaacatgcctttgtaaaacgcggttttctgaaagccggtaatatgcgaaacatacagcggcgtgaagacggcatttttcaaaatgagggagacagccccggcaatggtgatgccgtacagcccgagatgtgccggtccgctgagaaccacggccaatatgacattcagtccgcctaaacataaagtaacgacggcgggcgttttttgtttattaaaagccgtccatacgtaaaaaagcggcatgacagagagactgaccaccaaatacgcggcgtgaatatataaaagcggcgccgtctgcacaaacgacgggcccagccaaatcgccagaaacggttcggcaagccctcctaataacgcggcgggaagcgcgaggagaagcccgttcatccgcacggccttattggcgtaagacaggagaccttccatatcgccttttgaataataggaagtcaaaaccggcgcaaacagtgaagcaagcgtcccggcaagacttctgagcagaagcgggaattgaataatcgccgcatagacacccgcttcagacggccccagcacaaggttggccgtcatgaggtcaatctgcagaaacagcagcacgccgatctggttgacagaactccaggcaccggccgaaaacagcactttgcttgtctgtaatgataaagttttacggctgaaagaaaaccacggaatcaatttcttaaagaagaaaaaagtcagcacagctgcacagacggctcccgctaatgccgaaagctggatctgccagatcttcggcggcaggcacgtaaacagagcgagcacacacagcaccctgaccagcatttgcacggcctgaatggaacttgtgatataaagcttgttggcaaaaaacggccccgtcgcgaaccccgccataaaaaacgtcagcataaacagcacgctgccgattacgatagacagcctcacatccgttaagagcccggccggtacattcataatcctgtcaataaaaaaagcagtcccggcgagcggcacagcgagtaatagagatatcacgacagacgcggctaaataattgcttacatacgcattggcctcgtccctgttccccctgtgggcggcgacggagaaaaacctcacaacgactgagctcagcgcaacggtaataatagagaaatagttaatgatattctgtgtcagatggacaaacccaaaagcctcaacacctaatgttttcacaataaagggcgtcatccacactgataaaaacaccgatagtaaaaacgccgtcacattggcgccgaaattaatggcaaatttcatgctccttccgcactgcctttctctttcgatttccgttcgaaaaacgcatgcagaagaagaggaaggcgcattttgcacagaccgagcaccacgcgctccccggccagcagctgtttatggcggcacggcgtcctgcgcacggccgtttttaccatgtcatacgttaagattctgccgatatgcgccgtaatctggtgtgacggctgcggggcggcgcatgcgttggcgatcagcatcggaatctgatgcttgcacaaatatgtatcaatatcgctccggcaggcgtccgtcagcccgtttgcctcataaaaagccattttcgctgcatattgcttttgcagttcgtgatctaagcggggcttaaacggtgtttctgtaagactttgcggattttcccggtagatatacagcccttcgtctatcactttgacacgcgcggcttggcggaacgctgccaagttaaacggagagtcctcggcaaaccggatatcttcatggaacaacagcccttgcaatgcttctcgccggtatatatagcgccacacataccaaataaaccgatgttcgtgcgcgcgggtcagcaatgcggtcatttcatccgctgtgaagacgcggcccggcggaagggacggcggcatatacgttctttctttagacggcgtttctttgtaataaccgcagccggcgatatccagccggttcttctccgcttcttcataaagccgctcgaacattgtttccgtcacataatcatcgccgtccgcaaaaccgatataacggccgcgggcggcttttattccggcattgcgggccgagctgaggccgccgttttctttatgaatcacccggattctcgcatcttctgcggcgaattgttcagccatccggcctgactgatccggtgaaccgtcattgacgaaaatgatttcgatgttcctcagcgtctgttttgttaaagaaaccgcgcattctttaataaaaggctctgtcttatacatcggcacgatcacgctcacaagcggcgcggtcattgggcatcaccgctgattttcgagcgcagcccggcaaaataaacacttcgcaaagaaccgccttcctcatgcttgccgctgagcagccgatttacggcggatgttacggcttcagggtcgggacgttcaagcaatgtcatgttcggtatgtttttcagccattgatagccttccatcaccttatgatcaaacgaacgaatgacgacacaaggcgttttcgtcagcgcacaaaaaatcatcccgtgaagcctgtcagtgacgacggcttccgcgcctttcagcgtattccaaagcgcttccagctccttttcgcgtgtatggcggctgaccctccggccgaccgtcgtggtaaaggaatacagctctccgtactctttggccaaagcttcttttaccatcgttctgtcctcagccgtcagcgcgctctccttatcctcccgtaaacagaggtagatcccttcccgcgctatgccccgctcgcttttatccaaatataagaccatgtcaggctgtttgagcactgtttttccgggaaaatgacgcttcatccattgatacgtcgtctcatctctcgccatcaacaaaaggtcgggatgcgcattgtacacttttcgggcgcgcttcagttccttccgtcccttttttgattcagaaaagtgagccgtcgccggaagctgaacgatccgatattgccggaatgtttttatgataaagcggcgcgtccattcctcataccggtacaaatcccccatgttcccgccgccgatgatgaataccatatcatcggggtggcgctttttgatcagcacttttgccgatctgtatatatccttcatatccacctcgacaatgtcaaaatcgggatactcccgttcaagaaacgttttgcttgcgtaggcgatggcgtgatcgccgagattatcgtgggacgggagcagcgtcagaatgatcttttttcttgccgctgtaagccccgccgccccatccgctcccgttccgaaatgaaattgggacgggtatttgaccttaagcaaaagccattccgcgagattgatttttaaagattgtatcgacatgtcttcaccctctgattttcattttgtactcgattgcccgctgatacgcggctgatgccagcgacacgaacggaatcagcttcagcttcgccaaaagcagaaggcatgagcgtttggcgtcaaacggcgccgttcccgttttggaaaggctcatgcggaatacgggatcagcgcatatccggctgatattcttccacttctcagaaaaccggccgccgttattccgcttccattcattcagcaggcagactgttccgtgctgaacgatgaaaaaatccagctcctgccggtattcgtgtaagcagccgttttcacgcaaaaaagcctcgttcagccgatagagaacgagacctgagtcaaacagctttttctgatagctttgcacaatggaagtcaagtgaatccgataatgatagagcggctgatccacgtacgagaccgcacctgcgaaaacatgcgccctgaggctgaaatactgatcctccacgtgctccagctcatcacgaagcggaaagcgcagctgatgatgctcgatcatggatcttttgtacagcttgttccatgaaaagccgctgactcttccttcaaataaatctttcaggtaccgttgtttcgggcggccctcgtacgctgaagcgatcgttgaaacggcggtcttccccgtatccgcaaattcagccgcatattcgcaaatcacgagatcagcctgatcagccttcgctttttcatacatgcgcaggcaataatcaggttcaacccagtcgtccgcatcaataaaagcgataaattcgccgcgcgccgcctcgatgcccttgttgcggaccgcgccgagcccccggttttgctgatgaacgaccctgattctctcatcccgcttctgataggtttcaagaatcgccgggctttgatccgttgacccgtcattaacggccacgatttcgatattggcgagcgactgattgagcaatgaatctaagcatctttctaaataagtttccgtattatacacagcaattaataaactgaccgcgggtgtttccatataaacctccagtgtccattaccgggaaaaaatcgttctgtacggaagcacagacgaatcgaccggcataagcaagtaactgtaaagaaaataacagacaataatggcgatataaatcagcgcatttgatttttcatcaaaaatcctcacaaaataagggatcaggatcatttggtacaggccgaaatatatattaaaccgggcaaaaataacatcctttgtcgccaaaagaccgaagagcaggccgagcagacagaaattcacgatgacatcaatgtcaggccagagcttccgcagccgctcccggtagcagaaagccaaaaacagcggcagcagcagcaccgcgattttcacgacgttcatcccgttcgtattcgtcatcagccatttctcataatggccgtacgagctgttttccagcacgacgacaaacagcgaaatgaacttctgatacagaaacgtcataagaagaaacaatgccgacagtccgaaaatcgcgggcgaccaggctctttttctgacgagaaaataaaccggaatcataatcagcgctgaggaatgaaaaagcgaacacagcagcacgattgacatataacgcttccagcttccgctgatcacgtagcggacggcccaaaacaaaacggccgccaccatatactgcctgatcccgttaaaggaagcgtaatagtgatacgtgcccaaaaacaaaaatacactcagctcaaacggacggccgaactcaacgagcccctttaaaataaagctgcatgtcacgaccgccacggtgaaatacatgatttgcggatctttcgtgataaaattcatgagccagatgagagccgtaaaccccggatcaacggctgcttttttcgctccgaacccgaagatctcccaaatgctgccgtaatttcccgccagcttgtacattagcgcgtacgtctgaaaatccgtcccgactctgtagcgcaaaccggagaccaataccagcgatagcagcggaacgagcatgacgagctgattcggccggtatccggtcgaaagcgattgatcacgcccgccgcacattttcgcgaaccatgaccaaatataaacaattcccatattgactacatatacaatcattcgttactgttcctttttccaattcatattgtaaagcttcataacagcccccgcattttctcccgcgtcatatcccagccgcctgagggtttctttaatacgcgccccgtcaggctttgccgcctctgctgcccgtaaaaccgcggatgcccattgtcccggcggttctttgaggctgagccttttgaccagcccgagcccggcatcggcttcttccgttatgccgtctgatatcacgcacggcaccccggaggcctgcgcttcaacgagcgtgacgggcagcccttcataaagagacggcatgacaaatacatccagcgttttcagcagatcatgaacgcggtcttctatgccgataaaacgcacatcatcatcaagccccagcttcgccgccagattttccatatcggtgcgaagcggaccgtctccggcgagaatcagctgtaagccgatgccccgctctttcatatcagcggccagccggagcagaaattcgtggtttttttcttctgtaaagcggccgatatggccgatcaccaaacggccgtctgcaatgccccgcttccttttttcagcttctgtgtccgcgcacccgccggcaaataagtcgagatcaatgccgttcggcaaaagatgcacgtctttttctttcccgaataagaaacggcccgcctcttttccgcaggcgcacagtgccgtggcgtttgccgtgatcagccgtctgaaaacaaacagctgcatcccggcaagccgcgacgcccgccccgccacgacgtactgtgcgaatggcagatccgcaccgggacgccggctaaacgagcggcaagcgcgataaatcccgactgaaaatcggtatgggcgtgcacggcggcaaacgggcctttttcctgaatcacccgcttgacctgtttaacaaatgtaatcgggtttgtgctgccgatgctcggcacataaaaaagccgtccgccgagagcgagaatttcctcgtcataagcgcacggatcgttcctatgggttaaaaaatcaaactgcaccttcgttctgtccatcttccggtacaaattcatcatcatcgtttctgcgccgcccctgttcatcccgctgaagatgtgcagcacccgcatcggtttgtcagtcatgttcggcaagcccttctttttggcggatgtccctgtttttatgataacggttcatgaccgcgggcggcgtaatggcgcggatgagcggttttgcgatatacgcgtaatgggaaatcggcagcttcagccgtctgcatgcctgaaaaacgagcaccgcattatcaatggaatacgtaaacgatctccttttgaacgcatcactgtcctctcttactttatacagcgtttcctggagattgtaccctcggaaacccgcttcaaaaaagcgcagccacaaatcgatatcctccatccgccgcgtccgcctgactgaccggtagcctccaagcgctttgtacgcttcagcccgcatcataatggtgccgtggcagaacggtgtgcctttcgccataattcccggtttcggcacgggcggcaaaagccgggcgcccctgacgccgaattcatcaaatacgagcatccccgtgcccacgacttgatagtgggcgtgcttgtttaagaaagcggcctgtttttccagtctcctcgggttggagatgtcatcaccgtcctgcctggcgatataatcccccgttgcgtatgtcagacagcggttcagcgaagcggcaagccgttgattcgtcttattttgaatcagcgtgatccggtcgctgtaatgatccgcgtaacggcgcgcaatctgatacgttccgtcagttgacgcgtcatcacacataatcagttcccaattcttatacgattggctcaggatggattcaatactctccgctaaagtctcttcgcaattataaattcccatgataacggaaattttcggttgtgctcctgcattcatacgcttttctcctttttatccatataaccggcgtaaatgtgcgccatttcctttaccgtacgtgtttctgaaaaaaattccgccgtcctgcgcccttcttgtcccattgcttttcgcagacccggggatcggtacagcttttcaatccgatcggcaaatgccgcgctgtcccctgccggcacgagaaaaccgttcacaccgtcttcgatgatctcacggtgccccctgttgtctgcggcaacggcgggcttttcggcagccatcccctcaagcagattcatgccgagcccttcgcggatgcttgaggcgacggacagatcggcaagctgaatcagctcatgaatgtcacggcaaaaaccgtaaaaccgcacaatgtcggataccccgagtgattcagccttttttctgtacggctcttccatcgcgccttctccggcaaatacgagtttcagctccggaatgcggttcttcagcagtgccgcagcctcaatgagaagtccctggtttttattgccgtttaattcagcggggtatatgaggataaattccccggcgccgaagccgtgtttttctctcagacgttcactctctgcccggctcacagggcgaaacctgtctgtattcacgccgatgccgtgtattttcttcgcgccgcaagctgtttttttcatttgcttggcccgttcgtaatcctcttcattaatcgtaatcaaacaatccgtgtaagaagagagaaatttttcgatcgggtaataaagaagccaatttttcaggggcgctccatcgcagaagtgaaagccgtgcgcggtgtacagcacctttgtccctttttggcgcgcttgtctcgccgcaaggcgtgcaagcacgccgccgaccggcgtatgacagtgaatcatgtcgtagccgttagcctgaatgagccgtttcagccgcctgtaaacagaaagattttcgggatgaaacggcgagcgccggatcggaatggaaaacttttcatcaacgaatggaagattcatattgccgcctgccgcgacgtgcacctcccagcccatatcctgaaaccattgaaaatacggaagatgaaaggctttaaaatgataatcgacagtggcgcagaataatacttttttcgtcatctttctgtcctcccatcacacacctgcggccgcttcttcatgtactgattcgatcgcctcaaacagccgttttctcagctcatcttcaggcagacggctgaattcctccataaaacggatgagcacggcccaatccccgtcgatcgctttcccgatatggattttcggaaaaatctgttccgtatgtacttcattatgattcagcagttcttcatacatcttttctcccgggcggatgccggagaattcaataggaatctgttctgtcgtatagcctgataaatgaatcaggttttttgccaagtcgacgattttgacgggttctcccatatccagaacgaaaatctgccgcccttttgcaagcgcccccgcctgaatgacgagtcttgacgcttcggggatcgtcataaaatatcttgtcatcgccggatgcgtgacggtgacgggtccgcctttttcaatctgctttttgaaaatcggaatgacgctgccgcggcttccgagcacattcccgaaacggacggcggcgaatttggtgttgctgacctttccgaggttcatgatgaccatttccgcaaaccgcttcgtcgcgcccatgacattggccggattgaccgctttgtcagaagaaatcagcacgaatgtttccgttccgcacatatcggcggcttcggcgacatttttcgtgccgataatattgtttttgacggcttcttccggattatgttccattaacggcacatgtttatgggcggccgcatgatagacgacgtgcggctcgtattttttcatcaacgtaaagattttatctctgtcctgaatatcggcgatctccgcgtgaaaaagcacctctttgccgaagcgtgcggacagttcgttatgcaccgaataaatgctgttctccccgtggccgagaaggacgatttcatgcggaagaaacgagctgatctggcggcagatttcagaaccgatagagccgccggcgcccgtgaccagaatcgttttccctttgatgctgtcagaaattttgctcgtatcaagggtgaccggctttctgccgaggagatcttcggctttcacatccctgatgtgtccggcagcctgcgttccgagcaggatctcatcaaattgcggcatgattttaatatgggcgcccgtctgcacacattctttgtacagcgtctggagctcatgggtgcaaagagacggaatggcgatgatgatgtggtgaattctcagcctttgcaccgccggcataatgctttcttttccgccgatgacgggcaggcccatgattttgagcttatgcttcgtctgatcatcatcaataaaagccacaggcatgattccgagatcatttttctgcgtaagctgacggacgagcagcgttcctcccgcgcctgcgccgatgatcagcgcccgggaagagtcattttgcttcctgccgatcgtttctttcagcacgcgcgaaatcatccggcttcctccgatgaacaatagctgaaccatccagctgacggctaacagccggaacaaaatcgtgtggaacaccccgtattggacggcggctgtgacagctgcggacagcgtgatccccttcagcagatcaagcagctcgccaattcccgtatacgtccatacctgcttatactggtgaaacataaaagcgcatacatgatggctgatcagcatggtcacggcggtcagcagcaacgctccggagtcataaaagtgataagaatcctcaaaaaattgatatcctataacaacggaaagtaaaacgagatacgtatccaatgcaaaaatcattgaaagtcttctccggtaagtcaatctttcccctcctcatttatcggtttagctgatacggttttcgtaaaaacagacataacagctaagccgataacaatgcatcatcttaagataaattgggcatttaacccgtcctcacaccccgccaccgacgaccagcatctaaggcggcggaaaacgccgcccacagcagagccgagtgcctccgttgataaaggtaaggagacatcacctgcaccgctcaatacgagtagtgctctgtttttttgattttctttttattcagcagcgcccccaaaagctttgcctttgactgctggagcgcgtctttcgccttttggacggtatccattttcgtttttccgctcaagacgacgagaacgcttccatctgtctggttcgctaaaatctggccgtccgccaccgccaaaagcggaggtgaatcgaaaataaccagactgtaccggctgtacatctcctgaatcagctctcccatcgcctttgaagataaaagctcggccggattcggcggcgtcggcccgctcgttaagacgtaaaggttatcaatcagcgttttttgcaccgtttcgccgagggaagcgtttccgactaacacattcgtaaggccttgtacattttcaagctgataggtctcgtgtatcgtcggttttcgtaaatcggcatcgacaagcagcacctttttttcctgctgcgcaaataccgcggcaaggttggcggcgctgaatgactttccttctcccggaacggaggaagtgacgagaatagagcgcaaatgggtctgaacagaggagaactcaatatttgtccgaatggtgcgatattgttcagccaccaatgatttgtgatgtaaaacggatatttgagccagtccccttcttgatttcttttttctgaatcccaaacgcctcactccccgaaatgtttttcatcagaccgtgtctgctgatttttgatgtcatacacaacccctaaaacaggcaagtctgttttttcgctgagctgccgctcgcttttaacggtttcatcaagaaagtggagaaaaaacgcaagcgtcacacccgccatgagagccgcaccgaacgccatcatgatattcctgatgcgcgaaggcttgaccatcgggctttccgatgcttttgcctcggacaaaacaatgacgccttttatattcatcctgtcacggacttcttttttaaatgtcttcatcagcgtgttcgctatagcggcggcctgtttcgggttctcgtcctgcaccgctgcgttaatgatctctgaatcggtttcgctgcttgtcgtgatctttgcttttaaagcggatgccgtctcagaaagatgcagcttctgtttcactttctcaagcacaaccgggcttttcattatcgtttgaaacgtattgttgtaatgaagattcagctgaacgtcgctgagattcgaatttttttcaccgcttgtttcatgaatgagcacttgggtcgatgcctgataaacgggcgaaatcacccggaattggatgtatcccgtcatcagcgttacaactgctgtcatgataaaaatcagtaaaaatctgtgtttaataatgtcaaataactctttaaaactcatattctcattcatgtaattacagcctcatccttattgcatcaggcttaaacgcccccttctgttaatgattggattataaaagaaaaggtcgaaatttgaaaatttcaaattaagccatttagttctttttagagaacattatcatgattttcctcttatttactgcacttcccttataattttaaattttataaagaacgaaaaatttcttataatgaacaaaaaaatgccagtatacaggggagaattcagcacaatgattggaagaataattcgtttataccgcagaagaaaaggctactctattaatcagctagcagttgaagcaggtgtctctaaatcttatttaagcaagatagaacggggggttcactcaaatccgtccatccaatttctgaaaaaagtatccgccaccctgcaggtcgatctgacggagctttttgatgccgaaacgatgctgcatcacatgggaggcacggaagatgagtggcgcatccaccttgtgcaggccgtgcagtcgggcatgccgaaagaagaactgttcacctttacgaacaaactgactgaaaagcgcccggagcccgcatcctaccgtaacagaaaactgactgaatccaacattgaagaatggaaagcgctgatgcaggaagcaaaagaactcggcttgtccgttcaggaagtcagatcatttttagaacggaagcgttactgatgatatgctgatgaaagggcttttattcgcttcatgccttcatctctgtttataatgaaaagaaaaaaggggatgaaatcatgacaaaacttaccgttcaaacccgctgcggcgcactgaaaggaactgccggccgcggtgcccgcacatggaagggcataccgtacgcgaagccgcccgtcggagagctgagatttaaagcgccggagccgcccgcaccttgggacggcataaaacatgccgattcgttcgggccgatttgtccgcagccggatgatatgctgtccatatcgttttccggagatataccgcctcaatctgaagattgcctttacctcaacgttttcgcccccgattcagagggcgaaaaaaagcctgtcatggtatggatacacggcggggcattttatttaggtgccggaagcgaaccgctttacgacggatctgcccttgccgctgacggagatgtcattgtcgtgacactcaattacaggctcggaccgttaggctttttacatttgtcttctattcatgacgcgtattccgccaatatcgggctgctcgatcagatcgccgcgctgcgctgggtgagggacaatatctccgaatttggaggagacccggataacgtcacgatatttggtgaatcggcaggcggcatgagcatcgctgcgcttatggcaatgcctgacgcaaaaggcctgtttcataaagccattttagaaagcggcgcctctcatacgatgccggcggatatggcaaaagacatcgcggcggcatttattcatgaagccggcactgatcaattgcaggagctttccgttaatgacctgcttaagactgcggataaagtgcggcgctcactggatcaaaacatttttcagcttttgtttcagcccgccatcgatccggccacattgcctgcggaaccggtgaaagccatagcagacggggccgcagaaggcatacctatgatcatcggaaccaatcgtgatgaagcatatttgtttttcacccctgatacagacattcactccgagaaaaagcagcaagattatttgcattatcacctcggagaaaactgcaccgagcaagcggcagatttatatccgcattcattaaagggacaaatcgatatgatgacggatctgattttctggcggccggctgtcgctttcgcacaaggacagtcgcaacacgcaccggtctggatgtaccgctttgattggcatggcgaaacaccgccgtttcataaagccgttcacgctctggaattgccgtttgtgttcggaaactttgattctttgagaaagacgctgcaagagccgctcggtgatgacgcagaacagctttccaaacaaattcaatccgcatggctcgcttttgcaaaaaccggaaacccgaacacctctcacttcaattggcctgaatatgaaaccgattcacgcgaaactttgcttttcaacacggataccgctgtcgaaagtgatcccgattcagcaaaacgccgcatcctgtttcaagcataaaaaacgccaagggagccggctcccttggcgtttcattttcatcttacagacatcagtcagcttcgcagcatatccatttccgcattacccctgatatgttatattccaacccaatacgttaaccaaacattcataaaggagtttctatatggagaaatcaagtattatcggcacagctgccgttataatcggggcgcttattatcttagtttcatttatcttcctgcgcgacactgatttctatgccgtgaggtggataggggttgttatcatggttgcaggattttcatgcggtccggcccacaccatttcaaaacataaaaacaaacatgaaaaagaaacccggtaacctttactgggtttcgttcatacatttcattttatctcacttcataatgcaactccgcaaattgtttgtaacgcctgacatcagtcagcttcagtcctgtctcccggtctccgggtttaaacaaagaaattccgcggccgagcagaacgggggcgatctgaatgataaactcatcgacaagtttttcctccaaaaccgggtgcagcagatcactcccgccgacaatccaaatccgcttgccttcttggcgtttcaatgcatttataaaatcggcaggctcttcatgaataaaccgcacatgttcagtacgcccggtcaatgtccgcgaaaacacatagcattctttacctttgtacggaaattcctcaggcaataaaaccaatatttcctcgtatgtttttctgcccataatgatcgtatcgacagattcatagaaagcttcataatcggtgctgtcttcaccttcagttccgattaaccaatctaaagaatgattttcccgcgcaagatagccatctgcgctgacagctccgtaaaaaacgagctttctttgaccgctcataaaaatccctcccccttttttattataccttaaacatgcgggtgaaatgaaaaatgatagaatcgggtaaaaaccgccgttaccgggttttcgttttttcctgctttggagatgctgttaatatgccgtctatccatcttccggtaatcggcataaagaaatgaaggaagatcccgcctaaacaaacggttaataacgttccgatgcctaccggaccttttagcatcaaggccagtatgaaaaatatgaagtaaatgaccgttcttgaaaaaaagatgcttctcccggttaaatcacggacaattagcgttaaccgatcaaccgggatcggtgcgaaatttgtgtgcagataggttgcggttcctatccctatcacaactaaaccgattgcaaaacagcccgcctttccgtaccatagttcaggcgttatgactcgatgcagaaaaaaaagccacatatcaatcccgattcccgttatgaacgccgtaatcatccctgaaaattccggtctttgcctttttaacattgaattacagcaaattaacaggaaagcgatgatgatttcccagcttcccacggtaagccctgcatggacggacaatcccacaataagcgcatcaaaaggcgatgttccaagatctgattgaatcgtgacagaaataccaaaggtcaagatcatgattcctaaaacataaaaaacatatttcactttatcgtcctcattttcttattttatgttgcaaatacaacaaaattacggtatgtttactatacggtattttcattgcaaatacaacaaaattcagctggtatgataaatgaagaaaggagctgtatgaccctgagtattaaattaaaaaagtgcagccttaacgatataacagagctccgggagataagcattgaaacattcaatgatacatttaaagatcaaaattcacctgaaaatatgaaagcttatttggaaaatgcattccgctctgaacagctgaaaaaggaattatccaatccgtcttctcaattctattttgtttattatcatcatgaccttgcggggtatgtaaaagtcaacatgaacgaagcacagtcagaaaaaatgggggaagattctcttgagattgagagaatttatataagaaaaagccatcagaaacacgggcttggcaaatatctgctgaatgaagctgtgaaaatcgcaacagcacacaataaaaagaacatctggctgggcgtatgggaaaaaaacgaaaatgcaatcgccttttatcaaaaaatggggtttgtccaaaccggagaacactctttttatatgggggatgataaacaagtcgactttatcatgaccaaaaccctctcgtaaaaggatacaaaaaacccggccaagctgccgggttttttctcttattttaattttcccgcacggatatcatcggtcattccttcgtatggcgcttctgaaatcaatgtttcgttattgattcccgcattgttaagatacgtaatatccgcaaactcgggaacgacatatttcgggtacgtttcatatttctcacgtgactctttcatcacgtcaatgtaatcattttggtagcacaccgtgatttccggatgctcatgcacccatttcgggaagaaaataattccgtgcatccgtttttcattcggcataaagtttaaggaaacgtctgtgcctgtcggttcagtccatgacactttgtatacgccttctgtcagcttgacgatattcacttcctggtcgcgcacccaacggccgcctaccattccgctatgaatccgatagtcgatcgtatgatcatttttaatatagatttcatactcccagccgttttcatacgtgtaaatcatatggcttccgataaagttttccatgttgactcactctccatcttattattgaatttcataaatatctaaccgaatgtcatccggcaatctgaccgcagccccgataaacagccggtcctgcagatgctgatatgcctcattgcttgtttcaaacacaggcacagtgcggaaatacacgtgctcgggatcaatgatgcgtttcactgactcataaatgacttttttaaagaaggttcattcaaggacgtatcacctcccgagacaatatgtttgtttaaacatgtaactatttacatgattaattgtaacgctgttaaaatggactgtcaaataatgagctgtttccggttatgttttacagtgttcaataaaaaagacaagggcggcacatgccgaaacccttgtctttttcattaagctcatctataaaaaaacgcagacgagcgtcttcttagtaatcacaatctttatctctgcattctttctttctcacagcatctatagtgtgtcccataatcttgtcatttgctttatcataaataccgtcaaatttatttgatgtatcatcgttgtaatagccaaatacctctatcccgcccattggatctgtttcatatttatctttaaatgtaacgttatgtatgccttcataattcgctttgataaatttctccattcgttcttgagcaatctttatctcttcagcctgaacatttttatcattcatactcttcattataaaacctccggctgctattaagataatgaagataataatatattttttcacagaatcatccgtcccatcagttatgatgaagctcgcggaatggaaaaatggtggtgacatccgatgcatttagggtcttaagatttttctttaatgtccgcagaggatcatataagcggcaatccagagtacttctttattccagcgtctttttagtattcacattctttttcctgacattcgggtttctcttctgcatcgactgacgaaactcctatttcatcattcgttttgtcataaagtccgaaaaattctttttccttattaccattcaagtaccccttcaaggaaataccacccataggatttattttataattgttaatgtatgtaatccgctttatatttttgtaattagcttttatataactttccattttatttttcgcttggataaaaagttcttgttctgcttctttttaatcatggtggtacttcatgtagatacttcctgacgctatagttatcacaaatattagggcaattttgcatctcttcacaaactcatcctttcttagattaaatttatatcaacctcggggtgttgtacatgtctaaaaaacatcaacgtatcaagtatcagtgatcgagaatacttttttataagcgttagttatagttagatctaggttaaatgaagtgatgaaggagaaaggaattcaaatccagaaggaattggctgatttagttggttctactgaggctgcgataagcagatttaaaacaaatacaagatatgatatcacaacactattcattattaactgaggattaaatgtacctatggaagatttgttttatgtcgaggagatagagtaagagcaataaaacaaaattagctcagctcgattgagctggctaatttatcttgtacaaagcttatctttacattcttctttgggttcggcatcaaccgtatatgataatatttctttattgcctggatcatatagaccttcaaactctttttttccattcgtataacccttaatactaataccacccattggattaatatggtaatcatcggaaaaatggatattatccacatttttatagttcattgttaaaaacttttccatatgattctgggcttcttcgaataacgcaatctctttttccttctgatcatactgatgcttcataaaaagtcccccaactgctataattattaaaataaggataattatgtactttttctttttcatttggaaatcaaacccttcctataaataactgtcgttcttaagtaaacgaaatgagcgaaaacttgatatgaatatactttcagcatgtcaaaagcaaagctaaccaattcagaattcatcgcgattgttgctgacaagttaagattggaacttaaagcgagtaaaatgctgatctgacgttttcctgtcgttgagttgtcatgatatttgtacgcgtttaccgttaatatcggggatacctcgacaaatgagacggtagaggcgattgatctcaggaataggtttgaactgtatgagaaacatatcacgaattttgtaagataattaaacaaaataaatacccactcatcctgaggtgggtattttacctttcttcggcattgaccactgaaatacctatctccttgttcgttggatcatatataccggaaaattctttttctttattattatttatgtagcctgaaacttcaactccgcctgtcggatcgatattgtagtcttttgaaaagtgaacttcctgtacatttttatagtctttttttaagtaattcctcatatgatcttgcgcctcaatcacaagtttttcttcgtttttatgtttatcatattgatgcttcacgaaaaaacctcccactgctataattataacaattaggataataatgtattttctcatgcgtatcatcctttcggaactattttacaatataagaaaggtgatgtatatatgccaaaaggaaaagaaataaccgtctctgatgtcacagataaagaatattaccgtttgagtcaagcagcttacaattataaaatgttagccctgcatatgaaatataaaactccttataaaataagtaagacgtcatattggtacgttgagaaagtgaagcaggattctgatacgggtcttgatgcctttgtattctcaaaaggcatcaagtccaaaaacggaaaatggataaaatcaaaaaaccccgaaaacgtggtcgtcgcttttgcgggaaccgatatcggaaaagacccgatcaatgacggcgtaaaagcggacggcggcaatattgttttcggtaatgatccgcaaaaagaagtgtattatattgtaaaaaaagacgcggaggatacctcgaaaacactcggaaaatataatggaacgccctctcaagacgccatgctcacaaccggaaagtataagctgataacgaaaacatcgcaaatcgatcaagccgatcagctggtacgcagcgtaaagaaaaagtatgccggaacatcaacgattatttcaacaaccggccattcactcggcggcgctgaggccgaatacagcgcggtgaataatgatgtgtacgccgtcgcgtttaacagcccttccgtcgtgaaactgcacgatgaggaaacacagaaagacatcaacagcggcatatacgatccttacatccggtcaattatcaatccggacgacatggtcggggcgggttattggaacgaatatgaccgccacaacgggacaacgatttatacgaaaaacccctcactctcacagttcagccggaagcagcggcttgatgggaacttgaacgagcagatcggcaaaaatctcgcttatttctttactaccgtcattctgagaaatccggatacacacggcttaaatgaagcgaatttcatatttgaccgaaacggaaacatcacaaatccgaacggagatgagttagtcttcgataaaaatctcggcgctcttctgccggccggtgcgatcggaagcggagacgcgataaaagtaacgccgaaaaacgcaaagaagctggctgaaaaggtgcaggccatgactgaggatttgcggacgatgaaaaaagaagcgcagaacgcctatcaggagcacgatgaaaaaatcgccgagctgaaaacggaattttacggccaagtcggacacggcttgtttgatcagcttcaagcacaggacgtgaccaatacaattgaagatattgcgcaatcctacgataaaggaccgattttttacgacacacaggctgagcaggcgtttattgattctttgcaggcggcgatcacggaccttgaagagatcggcggattcttacataaaatagcggacgaatttcaggaaaaagaccagatgctcgcaaactggttaagatgatagaggtggatacataatgccgacattagacgaacttttagaacacaaggacgacccgatgaagaaaaggctgcagcggcagatgctgaaaaccgccatgacgcaggcagcggggacaaaactggaaacagtgcgccaaacgctgaaaccgacattcgaaatggacacattgaaagatgaattatatgaagtgtattcagcactattgaacagctttgaaggcaaggcgcaaaaagctcttgcgcagcggatcagtgaaagtgcgcggctgattgccggcaccgaacataacagagacacattcattaacagtttcaaaacaagataaaataaaaacctcgcagatttatcatctgcgaggtttttcctatcgtcttaactgagacgcgctcggagggattcgaacccccgacagacgtggtaccggaaaccaccgctctatccaactgagctacgagcgcacgttttttcaatcagatacctttatattataataaagaaacgcacagaaagcaactcttttttgattatacacaacaggattatgctgcacgaggacgctgcataatcctgcatcgtttaacggcattgattttcacaaaaaatgtatttcaggcggactgccctcggctcggtacatttccagccgcttcagaaaaagcgataatcacccgtttcagctttttttccaaatgtcctttaacgtccaataggtgaattcctcaacctttacggcgcctttctcagaaaacagctcaatccccaatctgccttcattcggatagatacggcttgtcatcgttgtttctccatgattggcgaatacttcaatcgaggatctgtcaataaagatacgcagcgccagcttgccgtttgcatccagccgcacccttctcacaccgtctttccccatcttggtgcaatcaagtgtcagctttttatccgttagattgtatgtcagcacaagttcttcttcgtcaaggccgcgaatcttaaaacctgccgtttcggcatcagaatcgtttacatcaaacacggctcggacttcaagcaggtcttcgggcgtctttgccaagtaactccctgaaaccgatcgtccggcacattcccgatattccattttccgcagctgcttggtttcttccacgggattcatcaaaagtttatgatcatcacgcaaagtcagttcccgcggcaaagtcagtgcaccgcaccatccgtccgcttttgtcggcatctcagattcccacatatccatccagccgatggcaattctgcgtcctttatcatctaataatgtttgcacggcgtaaaagtcatggccgtgatccagttctttaaaagcgccgtgtgtaaatttgtttgtttcattattatagtcaccgattaaatagccggtttgatgtaaattgttatatgaatcgccgtccgcctcgataccctggggcgaaatcagcaggacatgtttgccgcctaattcaaagaaatcaggacattcccacatataaccgagattaccgtcactttgggcgagaacccccgcgtattcccaatcacgcaaatcaggtgaacggtataaaacgacccgtccgacgttttcttttgaagagttgccgatgaccatataccaaacatcgcgatgcttccatactttcggatcgcggaaatgacgggcgctgtcttccggcggttccgtaataacagggttttcctgaagcttttcaaacacggttccatcttggctgacagcgatattttgagtctgatagaataggtctttctcttgatcaattatattatgtcctgtatagataagggctaatcttccatgatcatcgaccgcgcttcccgaaaaacagccgctttgatcgaattcgtcccccggagctaaggcaaccggcaggtgctcccaatgaatgagatctttactttttacatgtccccaatgcatcggcccccaatgctcatcatacggatgatgctgaaaaaagacgtggtattctcctttaaactgaataagcccgttcggatcattgatccaattcgcccgcggcataatatgataccccaatcgatatctttgtttcactttaccctcggcttccttcaaagcttcttccgcctgctgaattctgtccatttgtaacatcctctctatccgattttttgcagacgctggacacgcctgctgttttgtttcgggcccaataaagtaaatatggagatgacggtaaaaccaaagacgacgaatcccatgatgagataggtttgacggaaccccgcactgtcatataatcctcccgcaagcggcgacagaatcgacgcgcctgcctgagatgcgaattgaaaaccgacgagataaaggacggacgacagacgcgtatcaaaattggcggccaaatatttaaaaacggcgatcagcataatcggcaattccagtgcgtggatgagtttcattgatgaaatgcctacaggctcaactgcaattccggacccgacgatgcggaaagccattaaaaaccccgctaaaatcaaactgtttttcgctccgaacttattgacgataaaaggcgcaagaaacatcatgccggcctccaaaaacacctggaatgaattcagatagccgaatacttggttacccatcgacactgaaggaaacaaagacgcatagtagatcgggaactgctgatcataaacgccgtaaatgcaagtcaccccgataatgtacatcataaaaaaccagaaatcttttaataaaaagagccgccccacatcttttaaccggaccgattccgctctgtttttctcatgatcggtcatttctattttcacggacatgataatggccgttaatatgacggctgaaacagacgcgatccagaagttgatattgggattgatattgaaaagctgccctgcaaaaaatgcagccgccgcccagcccagcgagccccacattcttgattttccatactcgaaatcatacttacggctgaccttttcaatgtacgtttcaatcgcgcctattcccgccaaaaaagcggctcccaaatataagcctccgacaacggcgccaagaaagacgttgtattgtaaaagcggcccatagacgtagatataaaacggacccgtgaatatgagaagacagctgatcataaacaatatctttttcttcagccccaatttgtcagagataaaaccgtaaagaggctgcatgcacagggcaaatacggcgtttacagaaaagataatgcctgtcgctgatccgtttaaattgatttcctgccctaaccaaatcgcaaataaagaatagctggaagaccaagtaaaaaagaaaaagaagaaataagcactcagtttccaatacagactttttgagcttttcatttgcaccgctcctttaataggaccttttaatagtcattttgagccgcatacttccttcttcatattcatcacatacatgcgagctccgagtaagcgcttactttccgccgctgcttgattctttcactttattgccgccagccatctctccatacccgtcacttcccttcactccgtaaataaagcgctttcaaaaagaattgtatgtcaaccggtttcatatgtcaatcggttgacatatgattttctgattattccaatcaaacaaaacgcaccctctttatatgaaaacagaaacatggaatgtccttgcacatgtcagcctgattctctaaaataagtgcgtgacggaaattgtaagccatttcagtatgcaggagggcacgggaatgaagcctaacattcatgatgttgcgaaaatagcgggagtttcatctacaaccgtttcgcgggtattaaataaccgcggctatatcagcgaaaaaacaaaagaaaaagtgtacaaggcgatggaagaaatcaattactttccaaacgatctggcccgctctttattccgaaaacgaaccaatttaataggacttatcatcccaaactccagcaacccgtttttcggcgaactcgcctttcatattgaaagcatttgtacgtccatgggctacaaactgctgctttgcaacagtttacatcgaaaggataaggaagaaaaatatttggagatgctgataagaaaccaagtggacggcgtgatcgccgtgacttataaccggggaattctcaattatcacaagcagaatctgccgattgtcgccattgatcattacttatcggacacgattcccgtcgtcggctcagacaactatgacggcggaaaaaaggcggctgaactgctgattgaaaaagggtgccggcacatcgtccatctcaacggcccgattgaactcgaaacaccggcaaacctcagaagaaaagcatacgaagacgtcatgcatgaacacggacggaagcctattacatatgaagtacccttttatcagcattaccatgatattatttcaacattattcgatgaacagcctgacaccgacggaatttttgccagcgatgatatcatggcggctgccgtgatgaccgaggctaaaaaacgggggaaagacctcccgaatcaattaaaagtgatcggttatgacggcactgaaaccgttcaatcggttctgccggacttgacaaccatccagcagccgatcgaattgatttccaaaacagccatcgagattttagcaaaagaaattgaaggcgaatttgatgatttgccgctggaaacgtatttgccggtacggcttttggaaggacggacaacgtagtcagaccgttcagccgtatgtaccgacgcgactgcggtctattttgagcgctccggccatatcattttctcaaggctccggcgctgatcatcctcattttcactttgctgtttgaactttttgttttatgggaaaaatggtgttagaagaaaaggttggcattttggtcagcgttttgtttgacctttattgaccaaaaatgtatcatgtaaatacatacttacctaaaaggtgaaggaggagcattatgaatttaatacctacagtcattgaacaaacgaaccgcggagaaagagcttatgacatttactcccgtcttttgaaggaccgtattatcatgcttggatctgcgattgatgacaacgttgcgaactccatcgtgtcacagcttttattccttgaagcggaagaccctgaaaaagatatttccatttacattaacagccctggcggatcaatcactgccggtatggcaatctatgatacaatgcagttcattaaaccgaaagtatccacgatctgcatcggtatggccgcttctatgggagcatttttacttgcagccggagaaaaaggcaaacgttacgcgcttcctaacagtgaagttatgattcaccagccgcttggcggagcgcaaggacaggcgacagaaattgaaatcgccgcaaaacgcattctcttgcttcgcgacaaattaaacaaagtgcttgctgaacgtaccggccagccgcttgaagtcattgagcgcgatacagaccgcgacaacttcaaatcagctgatgaagctttagaatacggcttaatcgataaagtgctgacacgcaatacggaagaccagaagtaatgcccaaaaaacctgcaagagatgatgtctcttgcaggtttttttatgctttattcccattcaaaaaagtaatgaatgctttgacgacagataattctaacgctgaagaatcatacatgagccaagtatcgcgtatcacaggttcattatttttataggatagcgccaatgtgtataattcatcagaaggctgaagacagatttccggcacaacagaataaccgaggccgtttttcaccatctctttacaggtttcctgcctgtctacctccattgcaatgaaaggcggttcagtaaattggttattccaccatttttgaatcaaacttttcaaagaagcatcagtttgataataaatcatcggcaatttgggaaggtcctcactgttgatttcagtttttgaaataaggtacagcctctcttcattcagcagttgtttttctccttgccaatcataattccccctcataatcccaaggtgtacccccgaatgatgaagcagatccatcaccttcgcactccatcccgtattgacgtggaattgaacagacggatactgatcagaaaaccgttttagaatcgccgggagcttatactgagcaaaattgcttgagactcctaatctgagaaccccgctgacttcatggctcatattgagcatatcatccttcactcttctgaactcctgcagcatctctttcgaataatcaaccagatgttcaccttctgaagtgaactccatccctttttttcttttataaaaaaggcgcactccgaattgtgcttccaggtttttgagccgataacttaacgccggctgtgtcatatataatcgctctgccgccttcgtcatatttttttcttcgaataatgtaatgagcacaatccaatccttttcatccatatgaaatcccccaaaatatttttctgctataaaattttctcctattataaaagttttttatttaactttataaaaattatatgttttacttataatccttatttatcatacgatatcttccaaagggaccggtacctttttatccacacaaaatgatgtaaggatgagacagcatggaaaaagttcctgtaaccgttatgagaggcggcaccagcaaaggcgtttttattcttcaaaaagacatgccagacgatacaaacctatggagcgattttcttttagacattatggggagccctgacgagagacaaattgacggtctcggcggcggccattctctcacaagcaaggcagccattattaagaaatccgccagaaaggatgcagatgttgagtatacgtttgctcaggtcagtctgactgacaaatttaccgacttcaaaggcaattgcggaaatatctcttctgccgtaggcccttatgctattgagaaagggctcgttcaagctgaagagccggttacaaaagtcagaattttaaatacaaacactcaaaaagtgatcgcagcagaagtcgaagtcagaaatggaacatttcattaccaggggactgctctattccgggggttccaggtacagcttctcctatttatctttcatttcaccaggctgaaggagcggtgaccggtaagctgtttcccaccggtcagcctattgatgttctcgataccccgtatggaaatatctcggtatcgattattgattacgccaatccgcttgtctttgtaaaagcagaggacacggggcttaccggcttagaacttccggatgaatataccccggatatattggaaaagctcgaaatgatccgatcgattgcagccgagaaatgcagattcgctccgagacatgaggctgctgcaaaatcaccggccgtaccaaaactgacattaatctcatctccagcggattatatcgatacaaaagggataaagagacacgcagaagagatggatcttgtcattcgtatgatgtccatgcaaaaaccgcatcaagctttagccattacaggggcggtatgtacgactgccggcatgctattgcaagatacaatattatctgaattttcattctccgggagaacgatccgattggggcatccaagcggtattttaaaaaccgaggcagatgttgatccggatggaacaacgattaaagtagtacgcacagcaagaaaaatctctgaaggctatgtgtttactaaacaaagttacagcatgaatacgctcaatcacattggttaataccgtcttcagacaagtcaaagataaacggaggaatacgagatgatcaatgtaaatgcgtctaatcgattaaacagactgcctttttcaagggcccatcaagcagtgctcgttatcctttcattcgcttacttttttgattttatcgatttaaatacgttttcatatgcggcgccttcacttttaaaggaatggaacatatccactcatactatcgcttttattacatctgtctcctatttcggaatgtttatcggcgcctctgccggaggatggttttcagaccgtttcggaaggaaaaaaggtttaattctggttgtcacctttttctcttccttctccctcctctcttctctggcttggaacccagaaatactcggtgtttttagattttttacgagtttaggtatcggcgccacaacgattgtggcgagtacgtatatcagcgaatttttcccatccgcaactaaaggcaaataccaggcaatctgtattacaatcggcatatgcggaattcctgcggccggctgggtggctaaattggtcgtgccgtccgcctcttacggctggcggtttgtctttctattcggcgcggtcggtattttttttccgctgatcgccagaaaactggaagaatcaccgaaatggctggacacgaaaggaaaaagcgaacaagcacaccgcattctgcttgaactggaggcaaaagcagaaaatgaaaagggtgaactgcctgaaccagctccggctctgcaaagcagacaaaccgctgtaaaatccgttccatatcggacgctgtttcaaaagcctttagcaggaagaacttttgttttaatgacgatgtgggcagcttccaccattgcaattcaaggctttggcacgtgggttcccacccttctggtgaaagaaggcgtatcaatggatgagtctatcgtatacgtcactctgggaacgatcggtgccccgctgggcgctctcattgcggcgcaaatctctgaccgtgtggatcgaaagtgggccatttctgttttatcgttaattattatggcgcttggattcttttacggcatcaatcctttgccgatggtcattatcgtatgcggatttctcatgcatatgtttgagcgtactttcagttcgatcgcatatgcttatacgccggaattatatccggttgaagccagggcatctggaaatggcctcacttacggcgtaggacgccttgcaaatgtagccggtccctttgtcgtcagtttcctgtattcaggctacggatttttaagtgttttcttattctttacaggctgctggtttctttgtgcactgacagtcggtatatttggaatcggttcaaaaaaacaaaagatgcagcaggatgatttcatatcggaagaaactttcgtgcaacaaaagttgtaaacgcatacagtctggaaaccgcaaaacatccatctcctctgaggaaatggatgttcttctttcaaccccaacagcagtctcattcgcctcttattctcagacatatctcttattacgaagaaaggcgtggtacgcatgagaaggagaaaagaactttccgtcagaatgaattagatgcagccgccgaaacatatttcagaccgctgccttacaattcacgccatttcttatctaaaatcgggtatgtataccgattcatctgctcaatcagctcatccggccgggaggaactatgtatcagctttaaatgagactcattcgaaaatccttcctggatgctgtacttgaccatcttcatcatcggctcaaaatacccgttcacattgtacagtccgatcggtttttgatgaatgccgatttgcgcccagcacagcacttcaaataactcttcatatgttccgaaaccgccgggcatggcaatgtacccgtcggcaagttcactcattttcgctttccgctcatgcatgccgctgacttcaatcagctccgtcagattctgatgaacaatctctccgctgaaaagcccgctcggcatgacgccgacagcttttccgccgcctgccattaacgcatcagcgacggttcccatcagaccgacccgtgaaccgccgtaaacaaggccgattccctgctccgccatatattcacccagttcggccgctttgcgtttgtactcttcatttacccccgggtttgaccccgcaaatacacaaatggttttcattttttcatctccgcatctatatatgtacatcaataaatcaaaatacactatatattgtcccatctctatatgataatatcaataagaatcatacaggacataaggagtgtttcacatgcagatggctgaagcagaacaatggacgaaagatttttacgaaaaacgaggatggacggcgtacgggccatttatcagaatcggctttttaatggaagaagcgggtgagctcgcccgggcggtaagagcatatgaaatcggcagagaccggccggatgaaaaggacgcaacccaggctgaacgcaggcaggagctgattgaagaaatgggtgacgtcctcggaaatctggctatccttgccgataagtacggaatcacgttagaagatgcgatgaaagcccatcaggaaaaactgatcaagcgctttgaaaccgaataaaaacacggcccgtccgctttttcatggacaggccgtatctgaatttatcccgttatctcgtcctgatgctcaaagaaatgctgtttcccgattttatgaaacagccccgtcttccggatcagctctctcggctgtgattgcaatccgacgatcatcaatctcccgttatgccgtttgatccggttcatcacattccccagcaccgcttctgcggaggtatccatgtaatgcacattattcatcagcagaataagcgtcttcggcttttcctgaagcctctccagcagcgatgattccagtgaatcaattgaaccgaaaaacagcggcccttcaatggaatatgtgctgacggacgaatcatttttaaccgatttgaccgcggcatgcggtgttttaatgcttgttgattcgctcatttttctgataaagaaaacaaaagcgagcacaagaccggcagaaacgccgataattaaatcaaacagaaccgtcagcaaaaaggttgccgccagtacgaatgaatcagtgtttttcagccgcatcatattggcgacttccctccgctcactcatgttccaagccacaaccatcaataccggcgccatgcttgccagcggtacgtgaacggcaagcggggcgaagacgagcaggacgaggaggacggtgactccgtggacaacaccggaaatcggagaaactgcgccgtttttaatatttgttgcggtccgcgcaatcgctcccgttgccggtatgccgccgaaaagcggcgctgccatattggcgatgccctgcccgacaagctccctattgctgtcatgccgtgatcctttcatattgtccgcgaccatcgccgataatatggattcaagtccgccgagaagcgcaatgatcagagccgagggaaacatcatcaccatgttatcaattgagaaatccggaagctggaaagccggaagctgccgcggaatttctccgtaagcagaaccgattgtcgccattttgtcaggaaaaaacacgaccgcagcggctgtagagacaagcagggccacaagcgcgccgggaatcttcggcatcagcctggctgataacagcaaaatggccaaagcaattcccgcgatgaggatgctgtacaaattaaaggttccgatcttcttgcctatttccgcaatgttgaggataaagctttcatgcttttggatatcgcgcagaccgagaaaatgggcaatctgctccgagaaaatcagcaccgcgatcccggccgtaaatccgacgatcaccggcttcggcacgaatttcataatctttccgagcttaaatacgccaaacaggacgagcatgacgcctgccataaaaccggctacaagtaaattctcaaaaccatactgcatcacaatggcaaataaaatgggaacaaacgcccctgtaggcccgccgatctgatatttagagccgcccaacagcgaaatcagaattccggccacaataacggtgtaaagcccgtattccggaccgacccccgaggcgatggcaaaggccatccccagtggaatcgctacaattccgaccacaattcccgcgattaggtctttctgaaatttctgcaaattgtatccctgatatctgccggtaaattgcatcgtcagctgcatcctcctttgactgtttcataaccgtcaacgactacatccagcgtccccgttcccggatcgatcaccagcccgtgcaccggcacctcttcaggcaagagcggatgatgcctgaccatattcacgctgtgggccacgctttcttcgacgctgtgaaaaccggtcagccatgtttccaaatcgactcccgcatgctgcagaaggctgagacatttgtcctccaccccgcgctcttttgctttatttaatatggaagccgcatttaatcccgacattccgcactcgcggtgacctatgatgcagacttcctctgcctgcagttcataaacggcaaccaaaatgctccgcatgacacttccaaatgggtgagaaacaatggctcccgcgttttttatgattttggcatcgccgtttctgagtcccatcgcctgcggcagaagctccgtcagccttgtatccatacaggatacgatgacaagcttttttttcgggaattttgtcgtttggtaaggttcatatttcctttcttggacaaactgctggttgtgctccaaaatgcttgataaagaaaccatttttctattcatctcccatccgattgtattgcaagccttcttacccagcttacagtaaggaattatagcacagaaaaaggcctcaaaagcgctttcaaaaaaagacacgataatttgactgtaaattcagattatattcatttatatctttcaaaaataataaaatttatctttacaccaacctataaagcttttgaaaacagcggttccgctcattttgccttcagaaatataggcggattctgttattgtttggagaaatcaagcatgtacattcctttttctttcattttaagttcaaaagaaccagaaatttatcgtaatgcgtttgattatttctcacgttaccgcttctcttatataataaaatagagaagaaagacaaaggaggagaagcccgttgaaaccctatgtattcatcgcgaaaccgataccgcccgaagtcgaacaaatgatagacgagcattgccgctatgacatctggaaagaagataccattccaaaagagaaactgtacgaaaaaatgaaagatgctgaagggctgctgacatccggaacggcgattgacagtgatttgctggatcacgcgccgaagctgaaggtcgtcagcaataattcagtcggctatgataattttaatattaaagaaatgaaaaggcgcggggttgtcggcacgcatacaccgtacaccttagatgacactgtcgctgatctggctttttcattaattctgtcttccgccagacgggttgccgaattggatcgattcgtccgcgccggcaaatggggaaccgttgaggaggaatctcttttcggtatggatgtccaccatcagacattaggaattatcggcatgggcagaatcggtgaacaagctgccaaacgggcaaaattcggcttcgatatggacgtgctgtattataaccgcagcagaaaaccggatgccgagaaggaactcggggttacatataccgacttagatacactgctgaaaacatcagactttgtgcttttaattaccccgcttactgacgaaacatatcatatgatgggagagagggaatttaaattgatgaaagatacggcatgtttcgtcaatatttcccggggaaagacagttgatgagaaagcgctcatccgcgcattgcaagagggctggataaaaggcgccggtttagatgtgtttgaaaaagagccgatcgccgaagataatccgctcctgcagctggaaaacgtcacattgcttccgcatatcgggtcagcaaccgcaaaaatccgcttgaatatgttcaagcaagccgcacagaacatgattgacgccgtatacggaaaaacaccgaaaaacctcacgaaggaatttcaatgagatgaaaaatcccggccgtttcagccggggtttatttttcgctagatcaaaagtactattttaaaattctttctattcctttctcttgatgctgatacaatgaaaaggaatcagcttcacatgataaaaatgggaggtattgctttgaaaaaacgattatcgtggatttccgtttgtttgctggtgctgttctccgcggcggggatgctgttttcaacggctgccaagacggatacatcttctcacaaggcgcacactgaagcacaggttatcaacacgtttgacggggttgcggattatcttcagacctatcacaagcttcctgataactacattacaaaatcagaagcacaggccctcggctgggtggcatcaaaggggaatctggcggacgtcgccccggggaaaagcatcggcggggacatcttctcaaacagggaaggcaaactccctgtaaaaagcggacggacgtggcgtgaagcggatattaactatacatcaggcttcagaaattcagaccggattctttactcaagcgactggctgatttataagacgacagaccactatcaaacctttacaaaaatgagataaacacatacaaaaaacggcttccctgcggaggccgtttttttgcagagaatctgcaagcttcatataaaatgagcagtaaatttttcttcaaactctgagcggtctattctgctgttttccgccgtgccatcgtgtttttttattgttatattgcgttcagacagaaccatgtgcccttccggtgtccgcttagaagcaagcaggcgtttgttgaaaggagaacgttcatgttcaaagattgtttgtttcatagacttgaggtccttttcatcgatttcttcaagcgaaaatgcgtagcctgtctgccagccgtcccctttgttcatttcaagcacgtatgtcccgaattccgtctcttctatcctcacgcggaacgctccggccgctgataccgtctcgtctcccgacatcggcacaggctgcatggcgagattgaggccgaagcctgcatcagcgatgtactcatttcccccggcggaaagaagtacggccgcatgtgtgccgggcagcgcccagccgtttttccagaccgttccgcggatcaatttgacatcaaatccggcatctttcaggatgaaataaagcagtccgttcaagtcataacaaagaccgccgtgaggttccttcaccatgtgccgccacagtccttctttcgtgacgtcatattcttttttggacaaaacggcgcggttttcaaacggaaaccgatacgcgagcgcctttaaaaactccggcaggttgctgaaatcgagggaatccttttcccagcctatcgtttgataacaatctttcagaaactcattcatcgttccgtccccttacaaagtgtttacacttcttcctgcacataagcggacaacttttccagcgcttccttttcatcgtcgccttcagcgatcagagtgacttccgtccccgtactgaccgccagactcattaatcccataatgcttttggcattcactttcttgccgtttttctcaagaaacacatctgatgcaaaacgatttgcctcctgtacaaacaatgcagcggggcgcgcctgcaatcccgtctttaaacgcacttccactttcccctgaaccataagatctccccttttctgtacggttatttcaaagtgatgctttgtcctgtacgcagctgttctgcgatttcatcgagctttctcagcctgtgattgatgccggatttgctgattttcccgcttgcaaccatttcccccagttctttcagcgtgacctcctgataatcaatccgcagctgcgcaatttcgcgaagcttttccggcagcgcttcaagaccgatccgttcatcaatgtatttaatattttccacctgtctgagagaagccccgatggttttgtttaagtttgctgtttcacaattgacgaggcggttcactgagtttctcatatctctgacaatccgcacatcttcaaagcgcagcagtgaattgtgagcgccgatgacattcagaaattcagtgattttttccgcctcttttaaatacgtaatatagccttttttccgttcaagcgttttgctgttcagatgaaaatcattcagcagggcgcataatgaatcgttatgttccttataaagcgagaagatttccaagtggtacgacgatgtttcgggattattcacagatcctcccgccaaaaacgcccctctcatataagaacgtttgcagcaccgtttcgccaccagttcctcagaaatattccgttcaaatacaaagttctccccgaggattttcaattcctctaaaatcagctttgcattttcagaaaagcgcacaatataaacattattttttttcagccgcattttttttctgactaacagttcgaccgatacatcatattgtttcttcagcaatgtataaatgcggcgggcaatcgccgcattttcggtttgaacgtcaagcacgagatggcggtttgaaaatgacagggaaccgttcatccgaatcagcgcggacagctccgccttggcgcagcagtccttcacttccagattcgtcagttctttttttgtttccgatgcaaatgacatattagccacctcatttcaaaaggcctctagtcccttaataaatcgacaagaagagaagccactttatgtgtatcgtgacggattacgccatttttatacgtgataatctgatccctgatgacctcaagccccatggatttcagcttttcaacattgaagtcgacgggccgggccagctctttcgcatatttgcttttgatttcgtcagggatctcctcattgttgattaagatcgtgtcgataaacggctgctccatatgatcgttcagcgccttgacatggtcggccgcgctgtattgaagcgtctcgccgggctgtgtcatgacgttgcatatatatacttttttggccgcggccttgacgacttcctctccgattttcggcacgagcagattcggaagaatgcttgtgtacaggcttcccggaccgataatgattaaatcggcctgacggatgacgtcaatcgtttccggcagcggatcaattttttcaggcgtaagaaacacccgtttaattcgctggccgtaagaagggattgtcgattctccggagacgacctgcccgtcctccatttcagcgtgaagaacgacactggtgttggcagccggcagcactctgccgcggacattcagcaccttgctcatttcggtgacagcgtgaaagaaatcaccggttatatttgtcatcgctgccaaaatcaaattgccgagcgaatgtccggttaagtcgcttcctttgttgaaacggtgctgaaacagattttcaacgagcggctcaacatctgacaaagcagccagtacgttacggatgtcacccggcggcggaatttgaagttcatcccgcagacggcctgaacttccgccgtcatcagcaactgtcacaatcgccgtaatatcaacgggcttatgctttaacccccgaagcagcacggacagacccgttccgccgccgaagattgcgattttcggcttcttattcatttccggcttctcttttcaatgtcccggtgagtgacatgagtatagaaatcttttttaaaatagtcagccaaatactcagcgagcgtgacggagcggtgctggccgcccgtacagccgatcgcgatgacaagctggcttttaccttcccgcttataagacggaagcataaagccgagcagatcaacaagcttttcaataaacttttgtgtttcgttccacttcatcacataggatgacacttcctcatctttccccgtaagcggcctcatgctttcaatgtagaatggattcggcagaaaccttacatcaaacacgaggtcggcatctatcggaagcccgtatttgaaaccgaatgacatcacgttcactgtaaatgtttcaccttggttcgtggcgaaatgcgccacgattttttcacgcagatcacgcggtttcatatccgatgtgtcatagatcagctgagagcgccctttcaattcttcaagcagctggcgttccagcgcgattccttcaagaggaagcccggtagcggccagcgggtgagaacgcctcgtttctttgtatctcgtcacaaggatggaatccttagcgtctaaaaagagaatgcgcggtgtaatccacggattttccgccatttcatccagcgcctcaatcagcctgtcaaaaaattcacgtccccgcagatccatgacaagcgcgaccttgctcatttttgaacttgattctttcatcagctccaaaaatttcggcagcaaggaaggcggcagattgtcgacgcaaaaatagccgagatcctcaaagctttgaatggcgacggttttccccgctccagacattcccgtaatgatgacgagctgaatatcatggttttcattcatactcatctttctcccccctgcggtctttcttttatttgataagctgcggatctaaacgatagctgagcagctcgaagtccggcgtatacgtaaaggtgccgtgcaaaagcccttggcccttgatcataaaatcaaggatatgcccgtctccgggggccatcggaaggctgtggatatcttttacgtcatgccacttcagaacgccttcctctgattcagcgacattccgccccgtgtaggagtcggcgacgaaagtaaacatcatccactctgacacgatttgttcctgttccttaataataaaggtaaacacgccttttaactgcggatttagtatataaatgcccgtctcttctctgtactctctgatgacggaatctctgacggattcgccgctttccatcttcccgccgggcgcgacccaccagccccgtctcggcttttggagaaggagaacctgatcatctgtctgcagcacacaatttgtcactctttgcacaagtacgtcacctaaccttctcaacaaatcatcgtctcttcattataccgtttcggcatgtctctcacaatgcagagacaccgacatccttttcttttatttgacagaaaacaaaaaatcgcaaaaaaagggcacggatactggaatccgtgccaaagtgtattcattaaaaagggggtcaattactacattcatcttaaaacatcagtatttcacccgtgttacagcgtaattaaaacacagtaacgattcaaaaactgaacattacagtgattatttaacggttttgagcgtttcctcaagctcttccacataatgctgaacgctttgagccgcaatacttccgtcgcctgtcgccgttacgatctggcggagcgttttttcacggatgtctcccgcggcgaaaatgcctgggacttttgtctccatttgggcatttgtttcaatgtagccttcttcatttgtgatgcccaagttttcgaacggtttagaaagcggaagcataccgatataaataaagacgccgtcagctttgaattcttcctcttctcccgtcacggtatccacaagagtaagtctgccgacttttccgttttcctcatggatttcttttacggttttgttccatttgaagtcaattttctcattgtcaaaggcacgcgcctgaagaatgctttgcgcacgcaatttgtcacgtctgtgaacgatggtgacttttgaagcgaagcgtgtcagatagacgccttcttcaacggcggagtctccgccgccgacaacgacaagctctttatttttaaagaacgcgccgtcacaaaccgcgcagtacgatacgccgcggccgcccagttctttttcgccgggaacgccgatctttttgtattccgctccggcagaaatgacgatggcgcgcgctttatattcttttgaaccggctttgaccgttttatattctttaccgtccacgatttctttaatatcgccgtacgcatattccgcaccgaattttttcgcatgttcaaacattttattagaaagttcagggccgagaatgctttcaaaacccggatagttttcaacatcctccgtgttggccatctggccgcccggaattcctctttcgatcattaatgtggataagttcgctcgtgatgtgtaaacagcagcggtcatccccgccggacccgcgccgataatgatcacatcataaattttttcttctgacaccatgattcactccttttcgaaatggggcgcaccctatatgactaagaatccccatcaatcgtattccttacccatatcctattaaatctgagggcaattcgctatttttttgctcatttttctgagaaaccgtgattagggagctcctgagcgggtatacaaataaagaaagagccttccgggatagaaggcccttgtcttattcattattgcacgacacgtcttacattgccgttgaatgctttcttccagtaagggttgctcatagaatcaatggatacaccgtgtgatgtattatcgttcaggaacgttccgttacctaagtagatgccgacgtggccgtttgttttatacgtgttgaagaatactaagtctccgcgtttcatgtcagacgcgcttactgctttacctcttccgattaatgtatctgtgtttgtgccgcttgcaggtccgagattaacgcctgcgttagcataagcccagcgtacgaatgaagagcagtcaaagatacggttgtcaatatcggattgagtgcgtccgccgccgaatttatacggagattgacccacaaggcttgatcctacgctgatcgcgccttcaataccgcctgaatttgaaataacagatccgccgtcagaatcatctgaaccgccgctgttatgagatgatccgcctgaagtgctcttcggtttgcttgagctgtcagatgaatcagatgatgttgaaacagccgcttttttcacagttttaaccgccggtgccggctggctgtcatctttttggttttggtcttcagaagctttttgcgcttcttcctgttttttgatcagggcagccgctgcagcctgctcagctttaatgcgcttctgctctttttcagtgtcagctttttggtttgcaagctgtgacgcttcttttttcagatcagagatagcggaagccgcttttttctgaccgtttttcgcttcgtcgaaaagcttgtctttctgatcaagctgtttgttcaggtctttttgcatagactcgagtttcgcaagatcatcttgaacttttttcagcttcacgttaagttcagcctctgcgtcttcgagtttcgctttatcctgctcctgctgtttgatcaggtctttatccgcatcaacgatagaagatactgcagtcgcacgggaaatgaagtctccgaagcttgtcgcccctaaaagtacatctatgtatccttgagaaccgccgttttcctgtaaagaacgaacgcgttttttcaggatttcattgcgtttttcaatacgcgcttctgtttctttgatttcttttttcaaatcagcgatctgctttttcgttttttcgttttcagcttttttatcttcgattttattgcttgtatccaacgctttagcgttaatgtctttcagttctttttcaatcttagcctgcttgtcctgaagcttggacaattctctttcttttgcttcaaggcttgaagccacctcagattgcttgctttcaattttcgcttttttgctgtctaatgtttccgccgatgcagtttttgtaaacgggatcaaaaaactgcttgtcccgatgacggaagccaaaccaagtgttaataaactctttttcactttttctttcctcccttttactttaaacctgttctcatttggaattctattatgaacatcaaagttacgctccctcacatgcccgtgaggctgatgatttttatgtacgattctttgaatctggttaattggtatagattatacagcacatgtaaaataaactaatctcttatgtacgagactcattataccatcatgtttcgacaatttttattacagttatatttcaatgtgattgcaaatctcatattttgcaaaataaacggtgattacggcctgatttcgattcaaaaagcaaaaaaatacgtatgaatacctcttttttcggcggtaaagttctgttttgcccctttataataaaaaaaagaaccgactctttatatagaaagaatcggttttattctaatatatcatctatttgtctgatgtatttcgaaagggttgccggggttataccgtaaacggcggccgtttcttttttcgtcgttttttcgccgtttgcttctttccatacgtatgcgatggctgcggcccatgcccgctcattctgtacggcagcggcggcgcggatgtgctgaatgacgtgaaaaacccagcagctcatgacgtcagtttttaaactgtcggcttccgctttctccagaagcttgaccgtccgatacgtgaacagcgcgtcaccggagacgcctgaagcgcctttttcaccggaaagcagcagtctgacgaaatcttgttcaaacggtgaaacggcgcgttttgccgtcagaactttttcaagctggttccgctctccttcagcgctgctgatataataggcggcaagccgctgttcaagtgaagcaggcagcggttcctgccgctccgcccaaggcgcgggccggtctgattcgggaaattcggcttcggcctttttccaaatggtttccgcaaattctgtgcggcctgtcccgtaggctgaggcggcaagccagtaataaaacgtttcgtcgccttcgaacccgcttttgtaaagagaacggagccatttataaccgagatcatgtctgccgacaagcgcaagcgtcgcccccagcttatagcgctgttcgaataaaatcggatacacgttggcgagttttccgctcaattctccgactttttcatcttccctctcgtaatagcagaatacaaggaggttgcacagggcatggagattgccttcatttttctcaagcacttcgaataccgtctgtttcgcttttgtaacattgcctgagtaaaagtaagcgagcgccaggttgttgtatgcagaccaaagctcggggtaatcggccgtaatctcttcaagcatgacaaccgcttcatgaagctggccgctctcaagaagcgtttttgcccggtcctgcctgatcagcagctcatcctggtcatagagcgattcgttttcacccgcttcgccgaaatccaaaagctccatcagattttcaatctcttcgctgaattccccgtccggatcggcatctgaataagcctccgcttctttgtatgcttcctgaaagagccccaaatgcgcgaaattattcgctttaaaataatgacactcgggcatttcttctttcaggttcaccaaaataaagtcgaacagctcatttgactgctggtagtggcccatttcagaataaatgacggccagccgtgacagcatttcggaatcattcggctcgagatggacggcccgctgaatcagtttgctggcccgttttaaattccgctctttatatgcttttaagcctttatgaaaaaaatattgtccatcctgaagcagctggacaatttgcgcgtgctttttctgttcagaagtgtgttttcccacaaatatcctccgttttatacgtattaccgtcagtagtataccataaaacggtttcgcctcaatagttcaaaagacaggatcggcttcgttttttactggctggttcgaccagattttagctgtttttttcacgaggctcggctggaagaatgacgcggaaaagggttccttcgccgcgcttgctctcaacctctatcgaaccgccgtgcagctctgcgattttttgggcgatggacaggccgagcccgcttccccctgcgtttctcgccttatccgctttataaaaccgttcaaatacccgctccgcctgttcaggctccattccgattccgtcgtcggcgatttcgacagccgccgctcccggcagatcaacaattttaacggaaatgcggccgccttcaccggtaaatttcacggcattgtgaatcagattcatccatacttggctgagcagcgcttcatctccgtacacatacgactcctgtaaatcaatgagaaactcaatctgtttggcggaccattcaggctcacaggtcaatatggtgcgccgcagctgtttgtcaatgcggaacggttttttttgtatcggttcggtttggcgttcaagcgcagtgagcttcagcagattttcactgatttttgataatcgttctgtttctgtctcgatgatgtgtaaatagcgcccccgctcctcatatgataaatccggttttttcaggaggtgcgcgtagccctttaatgaagtaagcggggtttggatttcatgggaaacgttcgaaataaattcttgtttcagcttttccatttcactcagttccgcggcgagtgtcgacagttcatcagccaatttcgtcacggggtggtcccgttcaatcttctccattttcctggaggcggccgctgtgaagttgccgctcgacatttgcttgatcgtggcggtcagtgaatcccagatcgcatgatgtctttcacgtgctgactttgaaaagataaacatcgttataaacagcaggccgaaaacaagccagagcgtcagaatctgctcggcgtacggcacaagcaaaatcggccatatgagaccgaatccctgaacgatcagatgagccgccagccataagaatgcggtgacggtgagaaggatgatgatttttccagccgttctgaagatccgtttcattctgtcaccacaaaccgatacccgagcccccgcaccgtatggatagcaaacggatagtccttttccggaaaccgttccctcagccttttaacatgcacatcaaccgtccgctcgtcaccttcataatcaaagccccaaatatcttctattaattgttctcttgaaaacgtcttattcggataaccggcgagcttaaataaaagctcaaattcacgccggggcagcgtcaatcccgctccgccgccgcgcgttacggtgcgggattgcttatctaatgtgacatttccgatggtcagcagtttttcagcggtgatccggtaccgtttcagcaatgctttgacccttgcttccagttcaagcggctcaaacggtttgacgagataatcatccgctccggaagtaaaaccttgcactttgtccagcgtttcgccttttgccgtcagcatcaaaatcggaatgtccgtaaagctgcggacggcttcactgacttcaaacccgtccattttcggcatcatcacatccagtatgatgagatcaataggtgctgattcgatcagccgcaccgccgcttccccgtcttccgcttctgcgacgtcaaagccgctctgctccatcatgagtcggacaagctcacggatatggcggtcgtcatccgcaaccaatatgacagccataaaaatccctccttctgcttttttgcctgtcttcttttaatgaatcgacatgatgtctattaaccatcttattttttcattgtctcctgtatcgacagacactttttttgtatggcggatcatttcctccgtcacttctttcattacgccttgatcagtatcttcacgagactcccagcgcaaaggaacattgtatatctgaatggtgccgtcaccattgctgctgtaagtgactgacccatcgactaaccgggagcctgctaactgcgtaacatcttcgggatagcgggcgctcgtatgatcgtcagggttgacgagtgctccggccggaatgcggcgaacgttcaattcatctatctgctgattttccccaagctgcagccagatgcgggcatattcaatttgcagaggagaataatctgccgacaggcttttgtccgcagagatgtgatgtgaatctttgtttactggttcttttttttctgccgctgatgctgtttcagccttgttgatgccgctgctttctccggccggacttgaagaatggctcggctcttcatcgttaccgtccgtacacccggcagtcatgaatacgagcagtaaggccgcgtgccaataaaaaatctttgtgcgttttttcataatttaacccccgctttctatgaagagaactccggctgcaaaataaaaagcagctttttcagctgctttctattcataaagtcttgctttacacagctttgttttctaagtcggcattcagcttcagctgctgctccgcaaaatcgcggtacagcgaatgggatgccattaattcatggtgtgtgccccgtccggtgatttcaccctgttcgacaaagagaagctgatctgcatccacaaccgtggataaacgatgggcgatcacgatcgtggtgcggccttccattagaacttccagcgcctgctgcacccatttttcagattggctgtccagacttgatgtcgcttcatcaagcatcagaatgctcgggttgcgaaggagcgctctggcaatggcgatgcgctggcgctgtccgcctgacagcataattccccgctcaccgacctctgtttcaaatttcttcggtaagtcttcaataaattgcagggcgtaggccatgtcagccgcttgcctcagttcctcatcagtcacctcgcgttttaatccgtagcagatattgtcgcggatggtgcctgacattaacgggctttcttgcgacacgtagccgatatgctcccgccatgactcaagggaatacgcatcaatcggttcatttccgagcaggatgctgcccgcagtcgggttgtagaatcgttcaagcagcttaaataacgttgttttcccgccgccgctcggtccgacgatcgcggtgactttgccggcctcaatcgtagccgtaatgtcttttaagatggtttgatctgttttgtagccgaatgagacttgttcgagcttaatcggctgatccgcgttttcaatggcttttccgatttggatatcttcttctttttctgcaagaatatgaatcatccgttccgttgcgccgacggatttttgaagctgtgtgaaaaatgaagtgatctggcccatcggcataatgatctgaaacaaatacaggataaaggcaacgagtgcgccggctgtcaattcaccggatgacacctgcatcccgccgtacccgatgacagcgaccagcgccgccattaatacaagtgtaataagcgggcctacgagcgactgcaccttcgcttcacgcagcccgagtttaaagagcgccatgatgcctgcttttccgcgtccgtattccgcttcttcagcgtttgacgcttttacaagcctgatttccgggaggatgtggtttaataatccggtgaatctcgccgtttcatcctgtgtttcccgagaaattttaaacattttccggccgatcggcactaaaatcaccgcagccagcggcacgacgatcagcacgagcaatgtgagcttccagttcatgaaaaataagatcgtcagtgacccgataacggaaatgattccggtaataaatccgctgatattgtttgtgatcagctcttttaccaccattgtgtcattggtgacacggctgatcgtttctcccgtggcgtttttgtcaaaataagagacgggcagtttaattaatttctgccacaacaaatcacgcagtcccgagatgattttctggccgctgtagttcagggcgtaggtggcgtaggcgcttaatgcggcctgtacgatgaacacggctgcgatgattccgatttgcacgcctgacagcgacgacacggaaaagccgtcaacgagctgctttgtcaacagcggaatcagcaggctgacgagcgttgtcacaatactgagagacagcgcgaaggccagcataccgtatgatggttttgtttttttgactaatgaaaagaatgagctgaatttcccttttggttttggttgtttattcggcatatgttttcctcctatatcactgtttatactataacggatgtgcatgaacggaatatgaacaaaacgtatatttttgataaaaaccaaaataaactctattagtcaatattatcaaattcatctgcctacggttgcggaaataaggaatattttattgaatgtttaagtttgacagaataaaaacctcacgggtctctccgcgaggtttgttttactcagatgcagaatggcgtttcgcaaggacgtcaagcacgtcatccaaaggaagcgactgctcacgcagaagaacgagcaaatgatacagcaaatccgccgcttcccattttaattcttcatggtcgcggttttttgcggcgataataacctctgcggcttcctcaccgacttttttgaggattttatcgacgccttcccgaaacaggtacgttgtgtaggctccgtcaggcatctccgcctgccgtttggcgatcacgctttccagttcatttaagatgccgaaacgatcctgcgcgtctgctttttccgtggaaaaacagctgtagcttcccttatggcatgcgggtcctgagggctccgcaagcacgacgagggcatcttgatcgcaatcataacggatggctttcaccttttgggtattccccgatgtcgctcctttatgccacagctccccgcgtgaacggctgtaaaaccaggtttctttcgtttctatcgttttttcataggattctcggttcatataagccagtgtcagcacttctttgcttgccgcatcctgtatgatggcgggtatcagtccggcctcgtcaaaccgcagttcatctgcctgtttcatctcacattcaccccgtgtttcttcatataatctttcacttcttttatagatgtctctttgtaatggaaaatagaagctgcaagcgcggcgtccgcttcaccgactgtgaaggcttcaagcatatggcgcgcgctgccggctccccctgacgcaatgacgggcaccgggacggcacgtgagacaagctgtgtgagcgtatgattaaagcctgttttttcaccgtctgcgtccatgcttgtcagcaggatttcacccgctccccggctgacggcttcttttgcccaggccgtgacttcccgctcggttttctgtctgccgccgtgtgtgtacactttatagcattccgaatcttcgtcatactttgcgtcaatcgccgctacgatgcattgcgagccgaaaaactcagctccttccgtaatcagctcgggacggagaacggccgctgtattaacggataccttgtcagcgccggcgcgaagcattcgtttcatatcgcttaattgattgattccgccgccgaccgtaaacggaatcgccagttttgccgcaacttgttctacgacgtctgtcatcgtcttgcggccttcgtgagaggcggaaatgtcgagaaaaacaagttcgtcagcgccctccctgtcgtaggcttcggccagctcgacaggatcgcccgcatctttcagcccgagaaattgaatgcccttgacgacgcgtccttctttcacatcgagacacggaatgattcgtttcgtgatcatgcgtccttcacccttctgagcgcttcagccaatgaaaattgttttgtatacagcgcttttccgataatcgctcccgatacgccggcgtctttgaagcgggccagtgctttgaggtcggcgactgagctgactccgcctgaagcgatgacgtcttttcccgttgcttttgcgagctgaacggtactttcgatgttcggtcctgacagcatgccgtcagttgcaatatccgtgaaaatgaaggtttccgctccttcggccgccaattcacggcccagatcggccgccattaccgaggatgtttccagccagccttccgtcgagacatatccgtttcttgcatcaaggccgatcgcgattttgccgccgtattgtttcagcatgctcttcacaaatgccggatcggaaacggccgagctgccgagaatgacgcgatcaacgccttgtgataaataaccgtacacatccgcttcagaacggataccgccgccgatctcgactttgacatcaagctgccgcgcaatgtcaagaacatgcctgtcgtttactttcctgcctgctttcgcgccgtcaagatccacgagatgaatccattcggcgccttcttgtgcaaattgcgccgccatgtctaaaggagagtcaccgtatatcgtttccttgccgtaatcgccttggatgaggcggacgcatttgccgtttctcatatcgattgccggatataatgtaaaagcgttcatttcttcaccttctgttccgctgccatttttgtaaattgtgttaagatcgccattccggctgtaccgcttttttccggatgaaactgtgcaccgaaaacattgcgtttcccgacgacagccggaacacgaacgccgtactcagcgcttgccagaagatcgccgtcttccatcccgtctatataataggaatggacaaagtaaacgaagccttcttccgcttccgaaagcaaaggagacgtttggtgaaacgtcagccggttccagcccatatgcggcaccttcagcttgtttccttcggcatctctgtctttgagtctcacagcttttccggctaataaaccaagtccttttgcagagccgttttcggcgctctcttcgaaaatgagctgcatgccgaggcagatgccgaggagcagcttaccctcgtcaaccatacggtgtatgaattgatcaagcttcgtgctgcgtaaattgtccatggcgtcactgaatgatccgacacctggaagaataaaagcatccgctttttcaagctcttccggccggtctgatacgacatacgggacgccgacgcgttccagcgctttcgacacgctgaataaattgcccataccgtaatcaattacaccgatcatttacagcattcctttcgtagacggcacacccttgacgcgcggatcaatggatgacgcttcatcaagcgctctgccaagcgccttaaatacggcttctatcatatgatgggtattcgtgccgtaatgaacgatgacgtgcagattcattctcgcttcgagcgccagtttccataggaattcatgtaccagctcggtatcaaacgttccgactttcgcttgcggaaatgcagcgcgcatctcaaggtgcggccggttgctcaggtctacggcgacttgggcgagcgcttcgtccatgggcacaagcgctgatccgtaccgtttgatcccttttttatcaccgagcgcctccaaaaaagcctgccctaaacagatgccgatatcttcagtcgtatggtgatcatctatctccgtatcgccttttgcgtcaaccgttaaattgaattgcccgtgctttgtgaacaaatcaagcatatgagtcataaacggcacatccgtgctgatgtcggcttttccttctccgtctatttcgaaagccagccttatatccgtctcatttgttgttctggcgcgttccgcttttctcatcggtcattcctccgtttctcgcttcaatcgatcttgcgtgcgcttccagcccttccagtctcgcgaaggcggaaatgctgtccgcgtgcgtttcaaatgccttccggctgtaagagatgatgctcgatttcttttgaaaatctgttacattcagcgggcttgaaaaccgcgccgttccgtttgtcggcaaaacgtgattcggtccggcaaaataatcgccgaccggttcagcgctgtatcgtcctaagaaaatcgcccccgcgtgtctgatgcttccaagcaaagcctccggcgaatgcgtcatgatttctaaatgctcgggcgccagctcattcaccgtgtccaccgcatcttccatcgattccgtaatataaatgcggccgtgatccctgatcgacgcttcggctatttctttgcgcggcagggtctgaagctgtttattcacctcatctgataccgcttcggcaagcttctgtgaatcggtgacaagcacgcttgaactgagcatatcgtgttcggcctgtgaaagcaggtcagcggcgacttctttgggcaccgccgtatcgtctgccaggaccacgatttcacttggcccggcaatcatgtcgatatccacaacgccgaagacttcgcgcttcgcgagtgctacaaatatatttccggggcccgtgatcttatcaacaggctgtatcgtttccgttccgtaagcgagcgcggcaatcgcctgtgcgcctcccgctttgtaaatttcctttatgccgagctcagacgccgccgccagaacgcccggtgaaaggcggccgtcttttcccggaggactgacgagaacgatccgttccactcccgcagcgagcgcggggatgacattcattaaaacggaagacggataagcggccgtcccgcccggcacgtatacgcccgcggaatcgagcgccgttattttctgtccgagcatcgagccgtctttgcgatggtaaaaccaagaggattgcagctggcgctcgtgatattctttaatattggcaatcgcctgtctgatcacttccagcagctgatcatcaagcagacggtatgcctcggtgatttcctctgcgctcacggccatttggttcaggctgatgccgtcaaatgtttttgtataggccaaaacggctttgtcaccgttttgtctgacgtcttcaataatccccctgacggttttccgctgctcttcggttccgctgtcgatggaacgcttcagtgaaaaccgctcgcttctttttactgcggttatgttcattttgccgtttctccttccacaacccgtgccagcctggccgccatttcgtcgattacatcatccttcatgcggtagctgaccggattgacgataaaacgcgatgtgatgtcacaaatatgttctgattcaacgagaccgttttcctttaatgtccgcccggttgatacgatatctacgattctgtcagcaagcccgattaaaggcgccagctcaatggagccgttcagcttaatgatttccacctgctcgccctgctctctgaaataactcgacgcaacattcggatatttcgtcgcaatcctcggtgcgactccgttccaatccgccccgggaagccccgcaacggcgagatggcatttgctgattttcagatcgagcacctcatacacgtcacgctcttcctcaagcatgacatcctttccggcaataccggcatcagcgacgccatgctcgacataagtcgtaacatccatcggctttgccagaataaagcggagattttcttctggaacgtcaatgatcagttttctcgattcttcaaactcctcgggcagcctgtatccggcctgcctcagcaacccggccgcttcttcgaatatccgtccttttggcattgccattgtgagtaccttacccattcctctcttcctttctggcaccgataaagtatgtgacgtttgcgaatgattttgtcatatgatcgatattttcaatgcccgccagatcctgcaggacgacttttctgcctctcgccctttcttcctccgcgaataaaatagcctgggcccgctgctccttgctgaaaatcacggcgtccgcttcacttgtttcttcctgaatgccgagcgcttcaatcagcctgtcgatacggagcccgaagcccgtggcgggagcgggactgccgaaatggccgaggagattgttatagcgtccgccgcttccgatgacgaaaccgacatttgccgcgtacacttcgaataaaattcccgtgtaataactcatatggcttaccatattcagatcaaggcgaatatgctcggcacatccgtaatcctcaagaatgtcccacaggtcttccagctcctgaattaagctttgtccggagattccgatgatctcctccgctttggcgcaaatctctttcccgcctcgcaattccaaaagtgcgagcagccggcttttgtctattgaagaaagcggaagcgatttgacatgttccctgtatcccacgtaattcttttcaaagagaaagcgccgcagaacatccgcccgctcggcattgcccaaaacctcgacaaacagctcatcagcgagtccggcatggccgatcgcgattttaaaccggtgcaatcccgcgtttttcaaagcgccggccgccagcgcaatcacctcggcgtccgcgcttgttgatccgtcgccgatcagctccgcgccgacctgttcgaattcggccggacgtccgccttcccgctcctgagcgcgatagacgcttgccgcgtaccccgctctgagcggatgattgtgtttgtgcagcttagatgccgccaccctggcaatcggtccggtcatgtcgggccgaagcacaagcgtttttccgtcctgatcgagaagcttaaacagctgctgttcttcaatggctgactggacgcctactgtttcatagaattcaagggtcggcgtctccataaactgataaccccatttatcaattaaatccgtcagtgtggaacggacttttttcttggcttcgtataaaccgggcagcgtatctctcatgccatgcggtttctcaaacataaacatttgccttttacacctccgctttgtctgaaggaaaattccgaatcctttagttcgctaatatgataatatgttagcagataaaagaatggattgcaacgcccaatgtccgcctattcttttccataaacatggctaaagaatgaacaaacctgtaaacatatcggaacgatcgaatcatattgagcagaagtgctataatacatagaacagcttcatcagaaacaagggagaataattgataatgaagacgcttggaacattatgtgtgctgattctgacagccatccttgtctatctgggatataacatctatacaaacgatattcatttaaattttttcaatcagcagtccgacgagcctgatgagaaaacaccgttaaaagggagcgcgtcaccgctgaatgtcgttctgtacagacagatggattctcccagactgtacaatggctgtgaggtgaccagccttgccatgattttgaacaatgccggatatcatgtgtcaaaaaatacattggcggataaaatcaataaagttccgctcacatacagcagcgggctgaagggagatccgaatgaaggatttgccggagatatggaaaacggcccgggtttaggcgtttatcatgagccgattgataaacttgccaaagaatatgcgggaaacaaagtatacgatcttacgggaaaagacatttcttcagtgtaccgccagcttgaaaaagggcggccggtctgggtgattaccaccacatcctttaagccggttgatcatatgcagacttgggatacaccgaacggaaagatcgacattacgttcagcatgcatagcgtagccgtaaccggttatgatcacgattatgtatacgttaatgatccttacggctataaaaacagaaaaacagaccggtctgactttgaaaaagcctggaagcagatgggcagccaggccattgtgatcaagtcataaaaaaccccgctgacgttaatctgcggggttttccattcgttttttcatttcttcgtgcgtataaatcacctgcatcggatttcctccgacaaacgccccggcggggacatctttgtgcaccagcgtgccggctgatacaacggctccgctcccgatggtgacgccgggcagaatggttgtgtttgccccgatcatcacctcgtcaccgattgtgacaaaaccggtccggtactcacgtattaaatattcatgagccaaaatcgtcgtattgtagccgataatgctgttttttccgacagtgattttttcgggaaacatgatatccggcatcaccatcagcgcgaatgacgtctgttttccgacattcattttcaaaaaggttcggtacagccagtttttcacgcttaaaaacggcgtataccttgcaatctgaatgatgatgaaatttttcatcaccttcaggaagggaaccgtctgataaacatgccacaatgaatttgcacctgcaaccggatggcggtctgtttttctcacggattacttcactccggtgatgtgcaataaatcactcattttctcgagcatataatcgggttcataggcggaaagcgtctgtgcgcctttaatcgtccacgcgacgccggctgttttcgtgccggcgttttttcccgccatgacgtcgtgataattgtcaccgaccatgatggcttccgacggatcgcacccaagccggctgagcgcaagccgcacaggctcggggtcaggcttcgggtgctttacatcatcaagcgtgacgacagtatcgaaaaacgccccgatgcctgtcagcttcaatcccatattgactgtatccctcagcttagtagtgacaataccaagctgatagcccgcttttttcaattcatccagcgtttcataaaccgtttcgtactccgtgacgagctcatcgtgctttttatggttgaatgctctgtacatgctgatcatgtcatcgcacttttcggcattaatgcctgaaaacgtttcgtacagaggcgggccgataaacggaagtacatcttcccttttaaactgccccgggcaataatgatcaagcgtatgaaggtaagaagcgataatcagttcattcgtgtcaatcagcgtgccgtcgagatcgaataaaatggcggttacatgtttatcagtcatcttatgtcctttccgatttcagtcgtcagtccgtgtcagcataccgcttatcggcataccccttcatgcgtctgaaaatcattaaaataatcgcaagtataatcagcacaatggaaatgacctgcgcgatccgaagctggctcgtaagcatcaggctgtccgtccgcattccctcaataaagtatctgccgattgaataccagatcacatacgtcaaaaacagattgcccctgcgcaggttcacgcggcggagcagaagcagaatcacgacgcccgcaaaactccacagcgattcatacaaaaacgtcgggtgataatattgtccgtctatgtacatctgattaatgatgaaatccggaagatgcagactttccaaaaatgaccggctgaccgctccaccgtgagcctcctggttgataaagttcccccagcgtccgatggcctggccgagcagaatactcggcgcggcaatatccgccagcttccagaatgagatgcctcttacttttgaaaagacaattcccgttgcgatcgcgccgattaatccgccgtgaatcgcaatgccgcctttccaagttttaatgatttccccggggtgttccgagtaatagctccactcgaaaagcacataatatgcccttgcgcaaatgattgcgatcgggatggcgaaaagaacaagatcaataaaaatgtcctttttcagcccccgcttttcactctccctcatggccatccaaagccctaataacgcgcccgcgccgataatgatgccgtaccagtgcacggataaaggcccgagctgcaaggcaatcggattgatcggtgttccagcttcattcatattattgccaactcctattcgtcttgttcgccgtcctcaatgacatccgccagcttattcgtgaattgttcggcagcatttaagcccatccgcttcaatctgaagttcatcgccgcaacttcgataataacggcgagattccgccccgggcggacgggaatggtcagttttgtaatttccgtatcaatgattttcattttttcttcttcaagtccgagacggtcgtattgctttccttgctcccaaagctcaaggtccatgacgattgtaattcttttattgcttctgacggcgcccgccccgaacagcgtcatgacatttataatgccgagccccctgatttcgagcagatgctcaatcagatcaggcgcgttcccgacaagggtatcctgatcctcctgccggatttcaacgcagtcatccgcgacaagacgatggcctcgtttgacaagctccagcgccgtttcacttttaccgacgccgctttttcccgtaatgagcacgccgacgccgtatatatccacaagcacgccgtgaatggccgttgtcggcgcgagacggctttcaagaaaattcgtcagcctgcttgacagcctggttgttttcagaggggatctgagcacaggcacgccgttttgctcggaagcttctacaagctccggcgggatcggcatatctctggaaagtatgatagccggcgtcacatcggtgcacagcgatttcatccgctgtttcttatcttcctcgggaagctgatcgaaaaatgacagctccgtttttcctaaaagctgcacccgttctctcgggtaatatgtaaaataaccggcgatttcaataccgggccgtgataaatcactcatcgtaatcgggcggttaatcccttcttctccgctgatcaattctaaatggaactgttccattacgtctttggtccgaacctttgccaagatatgttcctcctgttctgggatgttccgagctttgaacagttatattttatcactttaccgtctgaaccaaaacagatttatacaattccggcataactggtctagataactagtctgaaaaggagtaaaataaaactaacaactaaccagaaaggcgtgttttaaagtggctgaaagcttgttaatcagcggtgcggacatcgtaacagaaaaagaaatcatccgaaacggttttctcggtataaaggacggcatcatttcttacgcgggaaaaacaaggccgcaagaaacgtatgagaaggaatggaaggcgcccgagggctcgtatgcgcttcccggaatgattgatatccatattcacggcggatacggcgcggatacgatggatgccgatgttgcggctcttgatacactgtccgcccggctgcccgaagaaggaacaaccgcttttttagcgacaacgatcacacagcagcacgaaaacattgaaaaagcgctcatcaacgccaaaaaatgggcgtattcctcaccggagacccaaaaaggcgctgagttgatcggcattcatttagaaggaccgtttgtctctccgaaaaaggcgggagcacagccgaaacaatggattactcctgctgatgccgggctctttcagaaatgggagcggctctcgggagggctgatcaaaatcgtgacgcttgcgccggaagaagatcctgatttcagcctgatccgttatttaaaaaaccaaaacatcatcccctcaatgggacacacagacgcaggagccgagcttttacaaaaagcggcggatgccggggcggtgcatatgacgcacctctttaacgccatgagctcctttcatcaccgtgagccggggggcatcggtacggctctcgcctgcggccgcatcacggcggagctgatcactgacggcattcattctcatcctctggctgttaagcttgcctatttggcgaaaggaagccaaaacctgatcatgattacagactccatgcgggcaaaagggcttaaggacggagaatacgaattcggcggacaaaaagtcaccgttcgcggggacacggcgcttctctctgacgggacgctggccggttccattttaaaaatgaatgaaggcgcggcgctcatgcgcaggtttacaaactgctcatggccggatatagcaaatatgacatcggcaaatgcggcccgccgcctcggcatattcgaccgtaaaggaagcatcgccgaaggaaaagacgccgacgttgttctgacggacggacagtgcggcgtgctggccacgatttgccgcggaaacaccgcatatatctcaagggaggctgattggacatgaacgttatcacatgcagacattatgaagaattaagtgaaaaagccgcagcgattatcgctgaaacagtgaaacaaaagccggatgccgttctcggccttgcgacgggaggcactcctgaaggcgtatacaaagaacttgtgcggatgcaccgctcagaaggcttgtcgttccggaatgtcacgacgatcaaccttgatgaatacgccgggctttctcccgaggacaaaaacagctatcattattatatgaatacacatttttttgcacatatcgacagccgaaaggaccgccactttctccctgacggacgggcagacgatcttgatgccgaatgcgggcgctatgaccgattgattcaaacactcggcggagcggatatacagcttttaggcatcggacacaacggccatatcggctttaatgaacccgggacgccatttgaatcccgaacccatgttgttgagctgaatgaagagacaagacaggcgaatgcgcggtactttccgtcaattgatcaagtccctgaaaaagccctgacaatggggatcgggacgattttgtccggcaaacggattctgatcatggcatccggaaaaagcaaggcccaagcggtgaagcagcttctggacgggcgcgtcagcgaagcattccccgcctccgccctgcacgcgcatccggatgtgacggtcttgattgatgaaaaggctgcgggcggcgattgaaaggatttgacctatgcagattgataaacaatctccgattccgatttactttcagattatggaacaattaaaaacacaaatcaaaaacggcgagctgaaagcggatgcgctgcttccgtcggagcgggaatacgccgaacaattcggcatcagccgcatgacggtgcgccaggcgctttccaatttggtgaatgaaggatttttatacagacagaaaggccggggaacgttcgtcagcaaactgaagatggaacagccgcttcaagggctgacaagcttcaccgaagatatgagaagccggggcatgaagccggggagtagacttgccgaataccagctgattcaggcgacggaagaattatcttctatcctggggtgcggctatccggcaacgcttcataaaatcatccgcgtccggctggcaaatgatatcccgatggcgattgaggcatcgtatatcccgtttgacaaggcgggaaaattggatgcctcccattttcaatcatccatgtatgagcatattgaagcgtacaatcagatgccgatctcacgggcaaaacaagagcttgaaccgggaaccgcttccgaggaagaagctgagctgctcggtatccagcccggcgcccccgtcctctatatcaagcggaccacttatctgcaggacggcactgcctttgagcacgtcaaatccgcctacagaggcgaccgctacacattcgtgcattatatggacagggtgaaatgaaacatctccaaccgttacgggttggagatgtttttttgatctgccattttcaaatcaagccggtgaatgttctctatgactctgtcaaaacgaagaggctggggttccggtatctatttttataaagaaaagagtaataaaatgctatcctctgttttggacaatatacggaacctgctttgaaatcagcagcagcggttctttgtttttatgagccaatgaaaacatgattgcgccttcaatcatcgagttgattgtcatcccaagcttctccgcttcctcttgttcaaacccatgctcaagaaattttgccgcaaacacatccgtccacttcttgaacacctcaacacatgtgcatcttaacgtttcattgatcagagcggtctcacccgccagcaatccaaccggcacgccctcaatattctgcggatcattaaactgttcagccgttacatgaataaagtgctgaatcgcttctacagggtccgcggattgagacatactattctgtatctgcttttcaacgcatcttcccgtatatttgatcgccgcaatggcgagttcttcttttccgtttggaaagtgatgatacactgaccctctgggtgctccgctctcttttataatttgattcaaaccagtcgcatggtatccctgaatctgaaaaagatatgcagaggtttgaataattctttcttttgtcccggttttactgttcattatgtttcctcctgcatattacgaaaaccaatcgattttagtatagaaaagggacataaaaaagtcaaaaacacttaccgccatgcatgttacagaaaaaaacctgctgaccgtcagattttcttctgaccgatcggcaggtgtatgtttttgctatgggtttgaggcatgcctgaaatcaaactgatccggagccgggtgatacggcgtatttcccgttttgaacatccacagcggtgatattgttttgccgttgtacgggtccttcacgacggtgtaccagtaataaacggaatcaggctgcaggccgtcccagacccaatttgcggtttttccgctttttacgtgttttttatgaccgagcagttcgttcgtataaacgttgcattcaaaataatcagtcgctacccttttcctcttcggctgtaaatccatttctgctgagaattcgtctttatcagcgaacagatcggtgtcatagtaattgatgtcatccgtgtacggcgagtaggagaacatgtgaacctgattggcggcctgatcaaattgcattatgcgcataaagccctgcccccttccggaccgtcctggtagtcggtcagaatttggtggacgaggcggtccggttttccgtctccgtcatcgtcaagcgcatcggtttttttcatggcgttatggtaatggccgcttaataccatcgccacattgcgattcggcttgacgacttttcgatagatcgtctccccgatcgggcttcgatttccgctcacaagcaagtactcatgaaagcataagatggcggttcggtccggatacctcttcagcacttgattgatccagtcaatctcttgttccgtaatgccccagcccatataaatcataataaaatcgttcccgcttgccgacagcagatcataatgcccgcggttatttttgtatgatccgccgtaatgcatgttctgttcaaaccggcggctcccgaagaaatccccgaaggttcggtatgtgccgtctttatggccgacgtcgtgattgccggcaagcactccgtacggaatccccgccttgtcaagcgtccgcatggagtgatcggcgtttttccactgtttcatcaccattgaatcatcgacaatatcaccggtatgaaagacatatttaatattgtgcttttccttattttctttgatccactccgtcattttgtcaaaaatgtgcgggtgcccttgtgcgtaatactgtgtatccgacatccagacaaacgtgtaattgcctttcgccggtatttgatcctgcacgatgacattcatttttgagttcttcaccacatccgctgcggaaacggcggcttttaatgtaaacggctttttatctttggcaaggacgctgtccgcctcctgccagcggcttgtccggtaattccaaatatacatggttacctttcggccgggcagagagcttcctttccagaccgcctcggccagatccgtttcgtcgatagacgggtcaacggagacttcgaaccggtgataaggaaaacgctccacactttccgccgaaacggtttttccgtcatttgccgagatacggttcatttccggcagggtaaacggcatttcattttcttttatgcccttcggcggttccgttaatgaggcgtgtttatacactttcacgctgcccggattccgcgcggtataacggaagccgcgataaaatgatacattcatgtcatccttcgtcgggtcttttacccggacggacagctttgctttgcgggcgccgattttttgaccggcaagctccggctggttcggctcctcccgtttgatatggaaggtgcggacggacgttgtttcatttccggcaaggtctgccgcaatgatagtaagggtgtgctttccgggcttgagatcggctgatgacgtgtgatgcgggagcgtaatgctttctccgtccaaaaacgctttcacctcttccactttgctccatttatcacggatgtccgcattcagctcaacattacctttcagcgccgcgccttctttaatacccgggacaatcttcggccccgaattgtccaccctcacagattggctcagctgctcctcaccgtcactgacaaaaatatggtgatagccttccgaaagcttcgccgtgttccacggcagcagccgtgacgtaaacaaatgatccggcaggctgaatgagaaggtcttctgctgattcgcccgcttgccgtcaccgataaacagctgctcggacgggtccgtcttcccgtctttgatcaccgttccgtccgaaagcaccagacgggcatgtttcacgacaaaatcatcccgattctctcccgtgtcatacggagaaacctttgagcccgaacggatggatactttctgtgttttgcccccttttagcagcagacgttccggaagcagaaccgagtgcgttctgtagcggtgagacggatcgtcaaaaatgtgcagcacctcgttttccatcatgacggtgttttgaaaataaagattcgttttccgggcatcgaaggcgaaatagacctctttttccagcgccggccgggtctcctgccgcttgccgtcaatccacagcttgatcttatcggcgctgacgtcggaagtcgctttgagcagataggtgccggatatcgtatcttccggttcaacattcattctgagtccgtgtgatttgctcgtctgttcaatgtcaatcatcttgacgggcgtttttgcttcattttctccatcactggctgcgatataatactcaagctgatcctggccgagcagttccggggaataaagaatgtgatggtataagctgtcgttgcggtctttttcggccagaattcgtttgaatggttttttctcattggtccggtaataaaacgcggctgttttgacaaggtttttgtcttttatgtcagcctttaattcaatgctttcagcgggccggacgggctttctgtctgtaaggtcttcgatgaccggtttttccttgtcgggtttgatcacccttttctgctgcggaatctgcgcctgaaaaacggagcccggtgacggcttatgctcgctcgtggagatcttcagcaattctcccgttccgttcagcggatatttgtacagcaaagaagtcagccggcggaaagcgtgtttccggtattgcgctgaggcgatatccttgccggtatttgccgacagcacgaccgtacgcgggcggccgttggacattccgtctgtcccttcgatgacggcgagatgttctccttccttcagacgtgtcccgtaatagcggttgaaatcatctatcgtcagttctgatgcggcgcgtctcagccaaaacacgtaagtcccgcctgacggaatgacggtatcctctttcggcctccatatcatatctgattccggcccttccttcggatagcggtagcggatatgatagtctttaaaatgaatgggcctgtccgtcgtgttatacacctcgataaattcataggcatcagcgccatcttcatttttcgtatcaaccgcaagctccgtaatcatcagctcgggaatatgattcaaatcggcttgatagccgtccagcttcagccgctttttctccgattccgcccgctgtctgccgttggtgaaaacgaggtaatattccaattctccattccagatatcccgttttgaaacctgggccgtaaaaagccggattgcgcctggcgcgggctccatcggcaccatcttaaaccccagctcattgctttgtttataaaaaagaaacgccgaaaacgcttgatagtcagcattccgtacatgagcctgtatgaacaggtttcttttcatttccgcctttacttcgatttggggaggattctccagaagcggtatgtaatgaggcggctgtccgaattcctgctgattcacggggattgccgattctttgcgcgccgcatccgcagaaggactcacacaaagcaaaccaatcagaaaaaagagcgtcatcacaagtttcatctcattacctccctatgcattatgttgcgtcaggaggctgccgcttatgtaaaccgcacataaaaaagctgccctctcgggacagcttgttttttatccttttctaagcggctccaatatgcctttttggatcagcaagtggaaaacggacagcacgacggatgcccaaatggcggtgccgaacccgtcaatctgaaagctgtctcccatcaaggctgcggtcatcattaacgtaatggcgttgatgacaaacagaaagaggccgagggtcacaaccgtgacaggcaatgtcaatatgacgatgatcggtttgatcagcacatttaacacagaaagaatcacactggcgatgacagccgctccgatactgctgatatggacggaatcaaaatatcccgcgataacgattaataataaagcatttactaaaatgctgactgcccatttgatcatttatttcaaatctccttctaaaggtacaacaaaacaccagataatatatacaatcggcacgattccgctcgtgacaagcgctaatacaacggtgataatgcgcaaaagcgacgcatccatattgatgtactccgccaaaccgccgacgacgccggcgattttacggtttttttctgaacggtaaagtcttttcatccaatcacctctgagtatgcttgagcttaatggctcctgttaacgattctgagaaaatcgagagatgctgatcatggccttgatttgatgccagcatcagttctttttgaatggtatcattcttttcctttaaaatttccgcatcaatcagctcatggctgagagagccgagattgcttttgagctccgctttcaccgccgaatcatcaggcagggcgatctccacgtttccggtcgtcgttttcgtgtagatggagcggcagtgcggcgctgtcacggtaagcatgatattgccgttaaagctttgaacgtcaatggattcactcgatccgcgcaaatcaatcaagccgttgatcgtttccgcttcaatcgcgccgcattgatgtccggccagcttgatttgtccgttagccgtttccgccgacgctttctcagccgtcaaatgagagaatgacagaacgccgtttgtcgttttcgccgagaattcttttacatgtaaatgttcccctctgatcggtccgttaaacagcttcactcttatcttatcgtactctttctgaggaacataaagcgtaacattggttttcatcgttttcttttccgtgcggacaaaaaacttattgcccttcacttcacactcaatatgctgaagaaatgcggtgcgcgccgcctcctgactgtccgcccggtacactttcgcctggcactccgctctgatatcttcatccgcccacggcacgatattgacgctgccgtttgcaatctgcatatcaatggccgagaattcactgtctttaaattgaaaaatatgctgcacttcgtgtgcgtggccgaaattcagatcaagatccgcttccttcacttttttgacggcagaatcaatccagtcgaacagcttcgccccgagcgacggcttttggcttccttttgcaccgctttcgaaatcttccgcaggttcctgaacctccgcagataatgcggtgatctgatcttctttttctttatattcatgatccagtttttcaatgagcgtcagtgcttcctgcgccgtcagcatgccgtcttccacaagctttaaaatccgttctttctcctgtttcatacaaaactcctcccccgacttttcttacacctggcgtaacaccttaattccctgcacgatattccaaatgaccattccgatgaggatcagaaaataaacagctgctcctgttatcataacaaaaacgggcaccatactctccccctgggccgtaatcaatccgccgacaacaccggcggtcacaatcagcaagcccgcaaacggaatgatatgggaaatcagagcgcgcatggcatgccgcttcgtctctttttcatcgacgacaaagtaagccacaatcggaagaatgagcggcgcgagaaacacgctgaaataacagattgatgcgataatcgcttgatttcggttcaataaaaacactccctgtgccatgatataaaaaaccattccttatacatacgtatgacgaatgagcgggtttcattttcatgctaaggacatgcttcgttatacgtaatttttggtttcagagatttcactatagaatcttttccccgaaccgattacaatatgtaacaaagcctgaccgtatgcaaggaggacatacaaatggagaaagatcccgaaaacgcccaagtaacggaagagagtcttcgaaatttaattcgcgaacagaaaagaatgaacagcgaaatgctggctgaattagaacagatcaaagcagcccctcttcccatttcccatgatatccaatatataaaagtgctgctggacagcagcagcacccatattctgcaggacttaatgcatttaagcagacagcttccccaacagaaaaaaagcctgtaacaacaacagcccaaaaccgatgagttttgggctgtttttattgatctattacgtggctgccgtttctttttcggccagcaatgttttcatccgttttttatcgcgttccattaccggtttcagatagcggcccgtatatgattctttcacttcgacaacttcttcaggcgttccggaggctacgatcgtgccgccgcccgctccgccttcaggtcccagatcgacgatgtagtccgccgttttaatgatatcgagattgtgttcaatgaccaaaacggtatcaccgttatcgacgagtctttgaagcacaaccaaaagccttgcgatatcatcaacgtggagccctgttgtcggttcgtccagaatatacagcgtccggccggtggaacgcttatgcagctcggaagctagcttgacgcgctgcgcttctccgcctgacagcgtcgtcgccggctggccgagcgtcacatacccaagtccgacatcagcaagcgtttgaagcttgcgtttaattttcgggatattttcaaagaaagacagagcatcttccaccgtcatatccagaacgtcggaaatgctttttcctttgtatgtgacctcaagcgtctcccggttgtaacgtttgccgtggcacacttcacacggaacgtacacgtcaggaaggaagtgcatctcaattttgatgatgccgtcgccgcggcaggcctcacagcgcccgccttttacattaaaactgaaccggccttttttatagccgcgcacctttgcttcatttgtctgcgcgaatacatcgcggatatcatcaaacacacccgtgtaagttgccggatttgatctcggtgtccggccgatcggcgcctggtcgatgtcgatcaccttatcaagatggtcaaggcctttgatttctttatggcttcccggtttcgctttggctttatgaagcttttgcgcaagcgccttatgcagaatttcattcacaagcgtgctttttcccgaaccggacacacctgtcaccgccgtaaaagtgccgagcgggaatttggcgttcgcttttttcaggttgttttctgaagcgcctttgatttcaatgaaccggccgtcaggctttcttctctccggaggcatcgggatgaattgagcccctgacaaataacgtccggtcagagaatccgcatcattcatcacttcttcaggcgtccccgccgatatgacgcggccgccgtgaatgccggcgcccgggccgatatctatcaagtaatcggcagccatcatcgtatcttcatcatgctccacgacaatcagtgtattgccgagatccctcatgtttttcagcgcgctgatcagacggtcattgtcacgctggtgaaggccgatggacggctcatcaagaatgtacaggacgcctgacaaacgggagccgatctgcgtcgcaagcctgatacgctgggcttctccgcctgacagcgttcccgccgccctgctcagcgtcaggtaatcaagaccgactttatctaaaaagctgagacgctccacaatctctcttaaaattaaatcggcaatctgcatatctttctcagacagcgtcaggtttttgaaaaattccagcgcatcgccgacggaaagctcggtaatggtgccgatgtggcgcccgttgaccaaaacggcaagcgcttctttcttcagccggtagcctttgcacgtcgggcacggcttctgtgacatgtactgctccatctgttcacggatataatcggagcttgtctctttataccgtctctcaatattgcgcagcacaccttcaaattcaatttcattttcgcgcacttgtccgaaatcattctcgtatttaaagtagatccgttcattgccgctgccgtacagcactttatcaagctgatgcttcggcaggtctttgaccggagtctccatatcaatgccgtaatggcggcagaccgcctgaagcagctgcggataatattgtgaactgatcggcgtccacggcgcgatggcgtgttcctttaatgacagttcaggattgggaatgacgagctcagggtccacttccagcttcaaaccgagaccgtcacaagtcgggcaggcgccgaacgggctgttaaacgaaaacagccggggttcaagctccccgatagaaaaaccgcacagcggacaggcgtgatgctcgctgaacatcagctcttcctgaccgatgacatctatcatgacacggccttcccctaagcggagcgcggtttccagtgagtcggaaagccgggcggcaaccccttccttgacgacaatccggtcaatgaccacttcaatggaatgctttttgtttttttcaagttcaatatcgtcggaaagctcggccatttctccgtcaatccgcacccttacgtaaccttgctttctgatttggtcaagcactttgacatgggcgccttttctgcctgagatgatcggcgcaagcacttgaagcttcgtccgctccggatattcaagaatccggtcaaccatctgttcgatcgtttgcgacgtaatttcaatgccgtgctccgggcagtgcggcttcccgactctcgcgtataagagccggagataatcataaatctccgttaccgttccgacggttgaccgcggattgcggcttgtcgttttctgatcaatgctgatcgccggagaaagcccttcgatcgcatcaacgtccggcttatccatctgccctaaaaattggcgcgcataggcagaaagcgattcaacataccgcctctgtccttccgcgtaaatggtgtcaaaggcaagggatgattttcccgatccggacagccccgtcacgacgacgagctgatcccggggaatcgttacatcaatgttttttaaattgtgcgcccttgcgcctttcacctcgatccggtcaattgccatgtgttcatcatccttccgctttaagctctaacagtaaatcacgaagctctgccgcccgctcgaaatcaagcgctctggccgcttctttcatttcgtgctccatttgctcaacgactttctggcgttctttcttcgtcatcttcgccagtttaggcgcggcttttgttttatattcttctttatcctcagcggcctgcgtcgcgcggatcacatcgcggatttccttattgatcgtttgcggcgtaatgccgtgaatttcgttaaagcgctcctgctgttcccggcggcgcttcgtttcattaatcgcgatttccatcgaattcgtgattttatcggcatacatgatgacgcggccttccgcgtttctggccgcccgtccgatcgtctgaatcagcgaacgttcagaacggaggaagccttctttatccgcatcgagaatggcgacaagtgacacttccggaatatcaagcccttccctcagcaggttgatgccgattaacacatcatgttttccgaggcggagatcacggatgatttcaatccgttcaagcgtcttaatctcggaatgcagataattgaccttgatgccgatttctttgagataatcggtcagatcctctgacatttttttcgttaaagtcgtcacgagaacgcgttcattccgttcaatcctcgcctgaatctcgccgatcagatcatcaatctgtccttcgatcggacggacgtcaatgaggggatcgaggagtcccgtcggtctgatgatctgctcgatcatttccggcgtatgctcaatttcatacggtcccggagtcgccgacacgtacacgatattgtgcatatgcttttcaaattcctcgaatcggagcggacggttgtcaagcgctgacggcaggcggaacccgtgatcgacaagcacctgttttctcgcctggtcaccgttgaacatgccgcgcacctgcggaatcgtcacatgtgattcatcaacgacaatcataaaatcgtccggaaaataatcaagcagcgtatacggcgtagaaccaggaggacggagcgtcaaatgtcttgaatagttctcgatccctgagcaaaaacccatttcccgcatcatttcaagatcatacctcgtccgctgctcaagccgctgcgcttcaaggagcttgccgttttcgcgcatcactttcaagcgctcctcaagctcctgttcaatattcagaatcgctttttccatcttttccgcccgggtgacgaagtgggaagccgggaaaatcgcgacatggtcacggtcgccgagaatttctccggtcaaagcgtcgacctctctgatccgctcaatttcgtctccgaaaaattccactctgatacaatgttcgtcacgggaagccgggaagatttccacaacgtctccgcgcacgcggaacgtcccgcgctgaaagtcgatatcattgcgggcatactggatatccacaagctttctcagaagctcgttccgctcaatctccatttccggtctgagcgacacgaccatttcccggtattcttcaggcgaaccgaggccgtatatgcatgacacactcgcgataataatgacatctctccgttcaaacagagaggatgtcgcggaatgtctcagtttatcaatttcatcattaatgcttgcgtctttctctataaaagtatccgtttgaggcacgtacgcctccggctgatagtaatcgtaatagctgacaaaatactcgacagcgttgttcgggaaaaactccttaaactcgctgtacagctgtccggcaagggttttgttatgggcaatgaccagtgtcggtttgttcacttctttaatcagattggacacggtaaaggttttgcccgtccctgtcgcacccaggagagtctggtgttttctgccttcctgtatgcctttgacaagcttctcaatcgcttgcggctgatctccctggggctgatatttcgagactaactcaaaacgatctttcacaaaaaagcctccgtttctttacgaaatcttcctattgatatagtaacacaatgacgggcaaaatcactaaaaatacgaactaaagttcgatggtttatttttaccaagtcaatttttgtataaaaaacctgcttttatggcgtaaaagcaggcattctatttcatattcaccatgtcaggcattgtctttctttttgtctgcttcttttttggccatgtacagccctccggccaccagcgatacgacatccaatccaacgataaaatacgtttcggtgtaaccctttaaataggatgcgaaaagcagtgcggctgtgagagcgatcgccacatagtggttaaacgtgacgcgcgtaaaaaggacgaccagcataaaagggaaacataatgcaaaaacggcttttgtaatcacaaaaaccctcctcgggaattcttcatctcatctgattatagtaaaaaatgaagaatcggacaatcgttcccctgctatcacaataccctttttcggcagtcttcaatcatctgtcaaagaaaatgtgaatataaatccattgaaccattaaccagatgaatcgaattacctttcttcagccgaaaggatgagaaggtttaggtctttgtatctttgacagtttcttcctccctctttacaatgtaatgatagtgtttactatcattttcttggatgaagaaaaaaagggggtcataccgcatgtattcagtgcgatttcaaaaagcggaagaatcgagccgctctgcaggagcaaaaggaatgaacctgattaaactgacgaaaaacgggctgcccgttcccggcggttttatcattcagacgaatgccctgacacgttttatggaagacaacgggcttcaagcagatcaggaacagctggagcgcgccattatgaacggcacgttttcaaaagagcttcgggaggagctgaccgcatcgttttatgaattgagagaatcatacgcctctgtcgccgtacgttcctcctccgcgtccgaagatcttgaaggcgcttctttcgcgggacagtacgaaacctatttaaatatcaaaactgaagaagagtttctcggaaaagtgaaagagtgctgggcttccttcttctcggcgcgggtcagcggttataaagagaaaatgaacaatgacaccgcagaaccgttaatgggcgttgtcgtgcaaggtttgatcaattccgaggtttcaggagtcattttcagccgcaaccccgtcacacatgatgacggagaactgatgatcagcgcgagctacggcctcggagaagcaatcgtctccggcagcgtgacgcccgacacatttatcgtcaataaagacacatttcagattgaaaaagaaatcggcttaaaagaaatgtatatcgtctctaaagacgaaggcgtgacggaaaaagagacgtccgctgacatgagaaaccgcttctgccttgatgacgagagcgtcaaagagcttgccatgctgacgataaagacggaggaactgtacggttatcccgtggatctcgaattcggatttgccgaaaataagctctatctgcttcaggccagaccgattacaacgatcgcgcaggatcagaaagcggcagacgaagaacgggaatttatcatgacgccccgggatcagaaagatttttggctcaatatggagtccaatatagaaggtcccgtcagcccgttattcgcttcactcattgtgccggctttggaatacggtctcaaagagagcacgaaggccttccctgtgatgggcatcgagattgagcgtgtcaaacttcatcagggccatgttttttccagacagcataagacggacgacaagctgcccgcagaacagttagaagcgcttttccccgtcttggctgaccgcatgtacaatattattcaggaaacctttctgcctttttatcaaaagctggacgaactggcgcatacagaccatacgccggagactgccattgatgcgttccgaaacctgcaagacttctatttaaaaggatacgcagaacatttcaatattgtctttccgcaggttgcgttaaacatgatactggaatctatgtacggacaggttgagaaagaaaacacctcccttctgtatgaaatgctggccggcgtcatgaataagtcattggagaccgacagacagctctggctgctttccggacaagtaaaagacagccctgagctgcggcgcgtctttacggtttctcatgccgatgagctgcatcagacgcttctgcaatcaaatgagggaaaacgctttcttgaacaagtcggcgaatttttacaggaatacggctggagatccgtgaaaagtcatgatctcattgaagaaacttgggcggaaaacccttatttcgctttggccaacattcagaactatgtccgaaacggatacgattttgacagtgagtttcataaaacgatagaaaaacgaaaacagctctacgccgactttatggatagaattgaagatgacggcttccgggagacgtttgaccgctattatcagtggacattgtcttcatccgtcatcaaagatgatcaccatttttatattgatgcgatgctggacgccaaagcgcgcctttgccttctgaaaatcggcgagctgcttcaaaaacaaggcgtaattgatgatcgggaggatatgtggtacttatacagcgatgaagtcgagaaagcgctggcgtcgccggttccgatgcaggaaaaagccgctgaacgaaaacggctcttcaagcaatatcaattgcttgaagcccccgcttatctcgggactccgacttcggaacagctgaaaacggctgaacagattaccggctccatcacagaagatgaaaaaaacactgaacatcaaatttacggacttgcagcgtcaagcggaatcgcaagcggaccggtgaaagtcattcgtgacgcaagtgaattttcccgtttttcaacaggagacgtgcttgtctgcaaaatgacgacaccgctttggaccagtctgttccaggatgcaaaggccgtcattacggacacgggcggcatcctgtcacatgcggcgatcatcgcgagagaatacgggctcccggccgttctcggcacacgtgccgcgactgacaggctcaacgacggagatatcgtcacggtagacgggacaaacggcaagattacaattgtcaaacgcgcttcatgctaggtttccctctttattgacgggcagggcgggtgtatacttgtcctgccagtatttacgcgaggtgaaacatgttgagaacgacgaacaagagaattattgacgccgcgatgaatctgatcatccaaaaaggataccgcgcagcgacaacaaaggaaatcgcagaaaaagcaaaagtaagcgaagcaacgattttccgtaattttaaaaacaaacaaggattaatgaaagccatgattgaacagcaggcgccggttccggaaagcatgatcaccaaggcggaaggcgatctgtatgaggatcttcttcatttcgccacgacccttctgcagcaattggaacaaaaaaaagaagtgttccgcatctgcctgcgcgaaccggaactattcgaagacgtcctgcaggatattgtcgtatatccgcaatccgtgaaaaagcatttaatcgtttactttaaggagctgacaaagaaaaatatgataagccccggcagcgaagaagctaatgcagacgtctttatgacgatgattttcggttattttatacaccggctgcagctggggaaaagagtcattactctctctgaggaaacgatgctgaaacacagcactgagattttcatgaaaggcattaccggccggtcattttccggctccaaggaggatgaaggatgggttcaaagaaagaatgggcgctgatcgtttcgcttttgctgggagccatactcgttcccatcaattctacgatgatcgcagtcgccctttcatccatttcccgctcattcagcgaatcaattgccagcatcacatgggtagtgaccgtgtatttaatcgtgatggccgtgacacagcccattgccggcaaactcggtgatatgtacggaaacaaaaaaatgtatttatggggcgtcggcctttttctcatcgcatcattggggtgcgccctctcgccaagtcttttcttattgattttcttccgggcgcttcaggctgccggcggcgctttgcttacgccaaacagcatcgccatcatccgccatgtcgtgtctgaaaaacggcttccgaaagtattcggctttttcggcctcggcgccgggctgggcgcagctctcggtccgtttatcggctctctattaattgagagcttcagctggcattcgatcttttgggtcaacattccgtttcttgcgatcgcactcgtgacggcattaatgatgtttcctaaatataaagaagaaacgtctgacgctccgcttgatatcatcgggtccgttttgcttgccggaagcattgtatctattattcttctgacgaaaaatgaaagctctttgggctattgggtgtacgcgctgctcattctcgtattggttccgctatttttcaggcgggaactgcgcacgaaacatccgattattgattttgacctgtttaaaaacacgacctttacgagcgccaatctgtcggttctgttaagcaatttaatgatgtacgccgtgttattgattatgccgctctttatgaccggccacttcagcatgaacacgtcgcacagcggcatggcgctgtcagtcttttctgttttcatgtccgccagcaactggggcggagctcagctgcatcagaaatggggcgcgcgaagaatgatttttctgtccttcgggctgatggccgcagccaatctcttatttctgcttttggtttattcccattccgttccgtttcttatggcatcgcttattgtaggaggcatcgcgtcaggtgcggggctgacgagcatgcaggtatcttctcttgcgacggtagaaccgggcatgtccggcatcgcatccgggattttctccaccttccgttatttcggaagcattatttcttcagcactgatcggtttaatctccgggtttcatattctgtttatcatattgatcggagtttctgtgatcggcttgttcgtatcgcttggaattaagtccggggaaaccgttcagacgaaaaaaagccattcggcataacgaaaaaggttccgtaagcatcagctttccggaaccttttctagttttccttcttcattttctctctcaaagtgtcaccgcaatgccgtttgctctataagaatcttttgatttacaagagaaaaggggaatgtaaatggctgagagttccgatcaagttcggcgctgacatcgtaatccggccgtaaaaagcccggccgccgtcttttattttatttatttcactcactcctatgttcaacttgagcccactatcattactatataaacctataagtattcaagatacatttaattgtacttctctatctcgctgctctgccagcaacaaattcaccatatcactatagctattcaaaccgtctgtctgattatttgccttcagatatacatcatttacatttcttgaaatacttgaaataacaccctcatacttatcccggtactgctcattttgttctatatcatgctgcaccgccttggacagactggacattatatcagacgcctgatctggatccactttctttagctcagatatagaataaacaaatgctagaaaaaaaccactgtaaagtatcattggatcatcctgctgcttacatgccagatatgctataaaatttgcctcatcctcatgcatgaaaccactctgatgtgccaattcatgtgccatagtagcaggcaccaagaaaacgggcacattaacattgatattggattcataagtaaaagggacaaagatgccatttatccctgcatgcgacattagctttgacatcacaactggttttggtgttgagtataaagaatgctccaaaataggatattcctttgataacatttgcatcgagaacactgcgtgttgtgcataataatcaaaaacctctggtacttgagccaaaagatcagtgtccgctaacttttcccttgccaattccatttcaacggcaagcgacttactcaatttgaccagttcctccttgctgtagttctcttctttatattcggtataagacaaaaaagaatatctgtaatagtttattccacccaaaatagtataacaaaaatatatcacgctacagatcgtaactattcctagagcaccacgataaactaccatcctacgtacacctttactcatgataaccttgcgcacataataaacgatataaaatagaaaaagtaacacaaccaacacgacgagccattcactaacagaaaacttgacccaagaaggtacaaatcctactatttttgacaataacggatatacagacctactgtatttttccgcccaatcctgatggttctgcgcgtattttgtcagtatgtaagctataactccaagtgaaatcaacggtaatctcttaagtaaaagcttttttataatgtactccccctatccaacataaccattataatcagttattcttaatatatatcctgctaaagattcatcttctaaaggttttggagttagcaataacctttccaataagccatacctctccttcatttatttttttattatttcaaaataaaacagctaagaaaatataattttcttagctgttttactttctaactgattttgaaatctagtttaggagttcttgaaactattccgaataattatgaaaaatcacattataatgctgtcatttcttcgtgctcgtgttcatcctgcacgaataaaatacctaattcatgatgttcgccttcataggacgcgcgctgatcaaaacggatctcaccgttcaggccgatgatctccatttttacaaatgcgcggtttttttgaagtgcttcataaaaatccgatacatgtttcacggggatgccgtttactttcgtaataatctcaccgatcttcagctcaagatcgtccgcgggtgtattcggaatgatgccgagcaccattaagccctgatcccgcttagagaaataaaacggagccgcgttatcgttcagccgctgtctcaatgataaaaacaggcgtccgagcaccgcaatacaagcggcagctccggcaagcggagtccaccaaagggcagctgccccgaatgcggtcacgataaccccgagaatcatgacacgtttcgccgttatccttatgctgacttccggaagtgacccctgcacacgctgtccgaagccggcgatataaggaatccagatcaaatggaaagagccgcccggtacggtaaagacaggccaccaagaaaggtgtgactcaagcccgctgcccggcaccaataagaaaagcggaagcagccatgcgcgattcgccaattgtcggccgatgggcaggcctctgctgctgacgacaagcgccggagatgttttcagatgcgctgaacggcaggcagccgctccctccgtgataatcaaaaggcccataaacacggccgccgatgcccaattcacgccgaatgcctgcggaaaccgatccgcaaacggcactgtgtgggtatactgaaggataaacgcaatgaacatgccggcgctgacaatataagctgaggacagccaattcatacggaacgtcagcgaaagcaaagcagtcacagccgcgattatgccgagaagaccgaatggaatcgaaattccaagtccaaaaaataatatggagagaagaatacccggtataagtccttttatgtatgtaaagataagctcgtcatacatatccgcgatctttgtatgaaacgtatggcgttcacgtttgatccgcaaatatccgcatgcgagacttatgatgataaaaaaccagaacatcgggtgcaaaaaaaacagaccgatacttttcagaagttcaattccccattgaacagacactgctttcaccgcctcaagccaaacattttaattctattctaccaaataatcattggcttgaatatctcaaacgtctatctctcttccgtcatccacaacgttacatttgagagagagaaatctttcagatagtggtcaacctccacctcgatcacgccgctgatcagaagcatggaccgcttaatatccgtcagattgattcctaaacgtttatggtttttcattaagtaagtgaaataatgcttcgcacactcttcattgatttcgtgaacgcattcaacatttgtgtaattgaccaggtatctgctgaacagcataagaagacttagtgcttttgttgatgaaaatgtgacgtcttttgttctgtcttttagttgttccactaattcataatattttttttcacgcacaatacttgccctcttcaattgtgaacccccatttttttatccagataagcacgggtgattacagctgccgtgctgaagcgccgcaaacacttctgctttcgatactgaaatgcagctgccaaactaaaactgttctctattagaaccttcttttattgtaagaactaaaactgactgaggcaactttcaaaagtttcattttgaatacatattaaatcggcataaagtctctcttctctataaatatcgggtaatgtttgtcctttataaatgtttaaatgtgaaaatttttttaatatcttgtcaaaaccgtcataattatatgtcttttggttcactttttatgaatgacaaaagaaacaggagacgcaaaaaacgcctccttttcatttattttacaaataatgattttaacgccatttgcagctgcaaatcatttttttcgtcagatttcttttcattcatcagctgattcattttttccgctgtctttttatcaatgaccgctgttttatcaagcttgtaccggtcttgaaacgccagaacggcttttttcattgttttgctgaaatagccgtccgctctgcccgggtcgaagcctaggcctttcagcaggatttgggcgtgcttgacatccgcgctgttcatatcaggctgaagcggctgtttcagctgaagcggtcccgccgcaaaataatccggctggctcacagcgattgtcggagcaatgccttttttgtgaatccaattgcccttcggtgtcagccatttgtaaagcgtcaatttaatgttgctcccgtctcccataggcacggcctgctgaaccgttcctttaccgaaagaagtgtcgccgacaacgtcataatgtcccgcttcttttaacgcgcccgcaagaatttctgaagcggaggcgcttcctttatccgtaatgacattgacgggatacggcttcttatgttttaaggttgagaaatattgttttttatcgccgttacgctccgcaatttggatatacggcatgtcttttgtgatgaaatgctttaaaatttgttcgacgctttgaaggtagccgccgggattcccccttacatcaaggacgagaccgtcaatcccttgtttttcaagctttttcagcgccgcggcgaagtcctcggcggtatgctcggaaaatgtcgatatgccgatgtagccgacatgatgaccgcctgattctttgcgggaagcaaatacggtttcaagcgggatttccgctcttttaatccggaatgacagctgtttttcagtacccggacgctgtattttaatagaaaccttcgatcctttttttcctctgattttcagcacggcttcgtttatatctttcccgttcattgacacgccgtttatactgatgatttcatcattcggcttgaggcccgctttttctgccggagattgcttaaacggtgatacgataatgattttattgtctttcataccgacttcagcgccgatcccttcgaaagaagaatcaagagaatcggaaaactgcttagcggtctgcttgtccatataaacggaataagggtcgtttaatgtagacagcatcccctgaatcgctccttcaagaagcttttctttatctacattttccacgtattcgttcgagatcagctcatatgctttttcgattttttccattgcccgggttctttctgcgtctgatgaattcggctgtgccgccccggcaatatgggctccgccgcacatcatgcttagggccgctatcactgcgatcattttctgcttcatcgtttacctcctcttagtcctttaacgaaaacctggagatagtatgtgtaaattgcaaagaattcatgtaacggcaacaaaaaaatgaaaaagcgagattgtttcatatatatgggtaacgtataatattttgtatgcaattcattaaatatacaggagaatgcgatatgaaaataaaattatcgattttatccgcggcggttctggccgcaggcattaccgcctttgtctggccaaaaacagaggccaatgagaaagcgcagacggacgccttgtatgtttctcccgcaggcagcgaccaatatgaaggaacgaaagaaaagccgttccgcacattaaaacatgcggctgaaaaggcagaggccggaacaaccgtattgattcgggaagggacgtacgatgaaacgtttgaagtaaagcacagcggcacggccgaaaagccgattacatttcggaactatcagaatgagcatgtctcaatcagcggcaaatctgcgccaaaaagcgattctgaaactccgttaattcaaatccgcaataaacagtacattaccattcacggcgttacgcttgagaatctctccgtatcatcagaagatgcgacggccatggggatctgcgtcaccggatcaagcagtcatatcaacattgacggcaaccatatccggaacattaaaaccacggctgatgaaggaaatgcacacggcatcgcattttacggcacaggtgccatgaaggatgtcagcattacaaataatacggttgaaaaactgacgctcggcgcaagcgaagcggtcgtgctgaacgggaatgtcgacggatttaagattgccggcaataccatccgggacaataacaatatcgggattgacgtgatcggatacgaaggaacgtccaagcaaaacgactatgcgcgaaacggcgtcattgaaaacaatacggtgagccataactcttcttacggaaatcccgcttacggagatgaatattcagcgggcggtatttacgttgacggcgcagaacatgtggacattaagaaaaacaccgtttacaacaatgaccttgggattgaagccacctctgagcataaagggaaatacgcacgagatatccggattacggataacaaggtgtacggcaatgcatacaccggtatttcaatcggaggctatgacacgaaacgcggcggcaccatcaattcggtgatcgctcacaacatcatgtaccgaaatgacacgaaggaccttgacggcggccagctgctcctgcagtacggcacaaaagggaacacgatcgaaaaaaacatcatgacggcaagcgattcacggatttttatcgcaaatgattttacgaaaaacgaagaaaataccgttaatcataacgtctatcacaaagaagagggaaaagacggcatctggaattggaagaacagagaatatgattcattcacagcgtaccgaaaaggaacggcaaacgattcggattccatttatgcggacccgatgtaccgtgacgaatcgtcttatgactttacattaaagcccggatcaccggccctgcccgtcattcagtaacgaaaccattaaaaaaagccagtctgtatcagactggcttttttatttatacacgaaggaatttccggatggaagtcagacttccccatactccgatcaccgcgccgatcagaatgagcacaagtgatacttgaaacacaaacggactgtacggcagaagtgaaacaaatgatccctgaactttcggggccacccaagcgaccatcgactggtacgtactcagcacgagagcgatcggtatgacagaaccgaatacccccagcagcagcccttccaggaagaacggccagcggataaaccagtttgtcgcgccgacaagcttcatgatttcaatctcttttcttctggcgaaaatcgtgattttaatcgtattcgaaattaagaacatcgccgtgaacagaaggccgatgattaacgcaatcccgatgttgcgtgacaccccgacgatcttaaacagacggctgacttcttctttcccgtatgtcactttatacacatgatcaagcttctcaatttttttcgcaactttcggcgtatcatgcggatctgtcgttttgacgataaacgcgttgttcagcgggttttcctgatcttgcattttcatggcctttccgctgtcgccgaagcttttgaccaattgatcaagctctttatctttagatgaaaactctacgctttggattcctgaaatgtcttttatctcattctgcagcgtatcctgcgttttcttatttgacgtcagatcgattaatactttaatttccacttctttttcagcatttttagccatgttgtttaaattcagcataatgactaaaaacacgccgaccaaaatcaatgtaacggtaacggcactgatggatgcaaatgtcatccacgtgtttcttccgagagatttaaaactctcacgcaaatggcgcccgagaattttaatcataagaaccatactcccctcttgactcatcacgcacaataattccgtcttcgatcgcgatgacccgtttcttcatggtgtttactatttctttattgtgtgtcgccatcacgacggtcgttccgcggttattaatctcttccagcgtcttcatcacttcccatgatgttaccggatcaaggttgcccgtcggttcgtcagctatcacgacgtcaggattgttgacgatggatcttgcgatggaaacacgctgctgttctcctccggaaagctggtcgggaaactgccgcgctttatgcttcagctgcacaagatcgagcacttcgagcacgcgttttttaatgactgactgctgctctccgataacctcaagcgcaaacgctacgttttcaaataccgtcaatttaggaaggagtttgaaatcctggaaaacaacacctattttacgccgcacgaaaggaatctctttttctttcacagccgcgagatctttatgattaatcaatatttgcccttttgtcggtttttcttctctgtaaatcattttaataaaagtagatttaccggctccgctcggtcctacgacatatacaaattccccgggatgaatcatgactgacagcccgttaatcgcttttacaccgttcggataggatttatatacttctttcatctctatcatgaaatcacctaatcttttatttatgtcttgcagccatagagttcgcaaacatacagcggtttatggccgattcgtcaggaaacagatgaaaaatctgaaagttccttttcctcagtacacttcattatacgtcaaatttagacatattactattacagtttcttttcattcccagaccgagaaaaaaccttgcccctataacaggcaaggtttttctgttattttttctgtgacagccattttgcgatcttcacggcttcctcatcatttacaagatggctcggcatattgccgcgtccgtttttaatgatgctttcaattttagcttcatcatacttcccgccgacttcctgtaaattcggacctccgccgccttctaggtctttaccgtgacagccgatacagctttgctgataaagttcttcacccgctgacgcagatgcttttgatccgcctgagctgtcagagctttcttttttcgattcattggatccgccgcatgccgccagcaggacggacatggtcagaaccagcgccagcagcgcccattttgatttcatatgtaagatgcaccccttcgctattataacctcgtttacgcgcgtttgaaaccctcgccgagcacctcgcttgcgtctgcgacaatgacaaaggctgactcatcaatttgtttgacgatttgtttcagttttgtgaattcggtctgaccgacgacacacattaagatcggccggtcatgttccgtatacccgccgactgcggaaatcttcgtcacacccctgtcgatttctttaaacacagctgatctgacggcttcttcatgctgcgtaatgattaaagccattttggagcggttgaacccgacctgcacgacatcaatcgttttgcttgaaataaataccccgagcatcgcatacagtccctgctccactccgaaaacgagcatcgcgctcagcacaattaatccgtccatgatggcaaggcacgttcccagcgacagccccgtgtatttgtgaatgatctgcgccgccagagccgttccccccgtggagcctttgccgagatacacgatgccgattcccgttccgatcccgacgcctccgaaaatcgccgccagcagttcatgggtcgtcgcggcaggcagatctcttgttaaaaagacggcaagcggcagaacgatggaaccgaccagtgtcttcattccgaacttcccgccgagaatgatcactccggcgataaacaaagggatgttaataatccactgcacataagccggttcaaaaccaaacgtttctaaaatggtgctgatcccgcttactccccccgctgctatacggttcggcagcaaaaatacgttaaacacgacccccgtaatcgccgcgccgatcatgatatatatgtaatctttgatcagacggagcggcttattgtgattcacatccatgcaaaatcctccgttctccgattttctctcgatagcattttaagtcttcccggcttagaagtaaataacagccaaataccgtattaatttgctaaagcgctgttgtgaaaaatggaaaaagagaacggataaaaaaacacaccttgccaaaggcaggtgtgttcccggattacgacagtttagaacgtaaataggcgtcaatgaagatatcgatatctccgtccataaccgcctgcacgttccccatttccgtattggtgcggtggtctttcaccatggagtacggatggaagacgtacgagcggatttggctgccccagccgatttctttctgttcgccgcggatttcgtcaagctccgcctgctgttcttcaattctgcgctgatacagcttcgctttgagcattttcatcgcccggtcgcggtttttgatttgggagcgttccgtctggcatgtgacgactacatttgtcggcaggtgggtgatccgaacggctgaatcagtcgtattgacgtgctgtccgccggcaccgctcgcccggtacgtatcaactttaatatcttcggtacgaatatcaatgtcgatttcttcattgaattcaggcatgacttcacatgacacgaatgacgtgtgacggcggcctgatgaatcaaatggagaaatccgcacgaggcggtgtacgcctttttccgcttttaaatagccgtatgcattgtggcctttaataagcagtgtgactgacttaattcctgcttcatctcccgggagataatcaagcgtttcaactttgaagccgcgtctttccgcccagcgggtatacattctgagcagcatggaaccccagtcctgggattccgtaccgccggcgcccgggtgaagttctaaaatcgcgttatttttgtcatatggttcactgagcagcagctgaagctcaaattcattcaattccttcgttaatgacttcagctctttttcaagctcttgctgaaggtcctggtcaggttcttcttttaaaagatcatgtgtcatttgcagctcttcgtgagactcgctcagctgatggtaggagttcacgtattctttcagaccgttcgcttcgttgatgacggtttgggccttctgctggtcattccagaattccggttccgccatcttttcatctaattctgcaatgcgggcttcctttgattcgaggtcaaagagaccccctgaagtccgctaaacgagaagccatattttcgagctctgccctgatttctgataattccattccattcacctcattaaaagatccggggcgccataagacgcagacccggtcatgttcgcttcatacagtcgagactattctgtccggccgcagcaatttttatatttttttccgcttccgcaatggcaaggcgcgttgcgtccgatatccacaaccttgcggaccggcgcttttttcgcttgtttggcctcatcgccgtcctgcggctgatgagccgtcgtttggccctgaacaacttcttcgcgttccagattgctttcaatctcggccttcatgacgaatttcgcaacttcgtcctcaatggactcaatcatgtgctcaaacattgcgaagccttccatttgatattcacgcagcggatttgtctgcgcataagcgcgaaggtgaatcccttgacgcagctgatccatcgcatcaatatgatccatccattttgaatcaacggcacgcaatacgatgactttttcaaattcacgcatctgctctgtaccgaaattctcttctttttcattatattttgtcatgatgcggtccatgatcatctcatgcatttcatccggttcttttccgaagatatcgctcttttcaagcgcgccttcatcaagatacgttgaattcaccagctccacgaggccgtcaagattccattcttccggaagctcctctttcggcgtataagcggcaatcgcacgctccagagaagacttgatcatgccttccacaatgtcgcgcaggttttcagagtcaatgacttcaaaacgctgcttgtaaatgacttcgcgctgctgacggagcacgtcgtcatattgaagaagctgtttacgtgaatcgaagttgtttccttcgacacgtttttgagatgattccacggcgcgtgacaccattttgctctgaatcggcgtggagtcatccataccgaaccggtcaagcatcgccatcgtccgttcagctccgaaacggcgcatcaattcatcttccattgaaagataaaattgtgtgatgcccgggtctccctgacgtcctgaacgtccgcggagctgattgtcaatccggcgggattcgtggcgttccgtaccgacgaccgcaagaccgccaagctcttttacgccttcgccgagtttaatgtcggttccgcgtcccgccatgttggtcgcaatcgtgacagcgcctttttgtcccgcttcttcaataatctgagcttcacgctcatggtttttggcattcagtacctggtgcggaatccctttattcttcagaagtttagaaatcaattcagacgtttcaacggcaaccgtaccgacaagaaccggctgtccggtcatgtagcgctgggcgacatcctccgccaccgccttgaatttcccttccattgagcggtagatcaagtccggacggtcgtcacggatgaccggctggttggtcgggatggatacaacctgcatgttataaatattgcggaattcttcctcttccgtttttgcggtaccggtcataccggccagcttctcgtacatacggaaatagttttggaacgtaatcgtcgccaatgtcatactttcattttgaatctccaggccctctttcgcctcaatcgcctggtgaagaccttcgctgtagcggcgtcctttcatcagacggccggtgaaggaatcaacgatgacgacctggccgtcctcaacaacataatccacgtctttctgcatcgccgcatgggcttttaaagcctggttgatatggtggttcaaggccacgtttttgacgtcaaacaggttgtcgatgccgaacgttttttcagccttcgtcattccttcttccgtcagctgaacgcctttcgttttgacgtcatacgtataatcctgatctttcttgagcgtgcggacaaacgcatttgcctgcacgtacagttttgtggacttctgagcttgtccggaaataatcaatggcgttctcgcttcatcgactaaaattgaatcgacttcatcaataacggcaaaatgaagcgggcgctgcaccatttgttctttatagagcaccatgttgtcacgcaaataatcaaagccgagttcattgttcgttgaatacgtgatatcggctgcgtaagcttcgcgtttttcgtcttttgacattgaattcaggttcaggccgactgtaagcccgagaaacgcaaagatttctcccatttgctgggcatcacggcttgccagatattcgttgaccgttacgacgtgaacgccttttcccgtcaaggcatttaaatacacgggaagcgtagacgtcagcgttttcccttcccctgttttcatttcggaaatgttcccctcatgaagggcgatgccccccatcagctgcactttaaacgggaacatgccggttacgcggcgggaagcttcacgaacgacggcaaacgcttcgacaagaaggtcatccgtcgtttctcctttttcaagccgctctttaaattctgccgttttatttttaagcgcctcgtcagaaagattttcataatctcctcttacggcatcaatgtcatttgctattttttcgtatttgttcagcgcacgtttggtcggatcaaacattttatttaaaatcccaagcatctataacgctcctctatgttcacatgcagattttgcatggaataaatgataattttctgtccatgtatacctctcattatcataacataccttttgctatttccaaagaatttgcagataaagatagagaaaaaccttccgcgcgttcacggaaggctgggtgggtttattcagtcggttcaattaatccgtatttgccgtcatttctgcggtaaacgacatttgtgagattcgtctccgcgttggtgaatacgaagaaattatgtccgagcatattcatttggagaatcgcttcttcattatccatcggttttaaattaaaacgcttttgacggacaatttccgggctgtcatcttcaatttcgtcctgaaccgctacgcccgtatcagcagcgctgccgttctcgaaataatgtttcggaagaccctgctcgcggaattttcggttgacttttgttttatgctttcggatttgacgttccagcttgtttgttgcgagatcaattgcattgtacatatcctcgttatgcacttcagaacgaagcgccagatcagtcatcggaatggtgacttcaactttggattccttatcgttatagaattttaagttgacgttcacatcggcattgacgctctgctcgaaatatcgttccagcttgccgatttttctctccacatgatcctttaacgcaggtgtaacctcaatgttttctcctctgatattgtagttcatcaaagaacgcctccctttatctaaggatatgtaactatttctcttttaccccttctgatccctgctgaaacgttaaaataatgtgtaaattcggtgaacgatgacgaatggtgtcggttttatccggcagcttccggcaggattataagtatatgcaaaggacgcaggcaaaagacctgccgcttgcagcaggtctagtgaagaacatacggtttgatacagtcgtgcgtctgctccatccatagcttataatgcggcagaaagatggtttttaaaaactcctgaaaaggggcggacgggaaatcataatcatttaacatgctgaaatcctgaaagatctcgtcaaatgagcggatcgccgtctccacgcatcggcactcaatgatagacagcagaagcgcatgagaggaatcgagatgaaaaaaagcctgaatcaaatcgttgtaaatccgctcgccctccgtcttaaaaaaatcatcctgcgtgtccaacaggtagcaaagcccctcatcaatcgtaaaaagaagctggtaataggctgacaccaaatggtaatcgttcaaacttctcaaaacactcacctatttgcgtttgtcgtaataacggccgtcacttgtcgtttgctgatacggattgaaatacgtattatggtagattcgttttttcttaagcgtttttatttcatttcggataccatcctgaatccgtttcacttcgccggtaatcagacggtccatcgcggccacctgctgaagcagcgttttttcttcttcggaaaaaggcggctttatgcccgcaagcatctcctcccttttctccgtaaatgccgtaacgctgctgatgagaccgtcgctttccggggcgtccttcagtgcggcgtacatgttcttcgtttcgttatacaaagaaaagacattgctgttcatcaggcaaggccgcccgcgccatggctgtttttccgttcactctgcatggcctgcttccacgtgtcgcgaaattcagtaacgagcttttccgcttcatctaaaaactctccgttattctgcacgttcgcgtcgatcagccggcggcggatgtaatcataaatggatgacatctgctcggaaatctcaatctcccggtttaacgtgatgctgagctcttgaatgatgttttgcgcctttacgatattttcatttttggcttcaaggttgttttgcttcatcgcctgccttgccagcttaatgaatcgcaggcagccgttataaagcataagggtcagctcttccggagcggctgtaaagacggatgtctgctggtaagcagcaaaaggattatttattgccatttttataaaacccccaaggttatgaagttgaagatcctaacattgacgtgagatatgaagattggctgttcaatttctccaatgccgtatccagtgcgctgaactttttataatatctcgtctcgatgtcatccagcttcgttttcatattggaaatatttgtttctatttcatccaggctttttccgatggcaaagctggttgataccgagctttccgtacccgcctgttttgaaatttgaatctgcattttgtttaatgtgtcttttaatctccgggcaatcccctgttcctccgggtttttggttttcgctgtatcagggctgtctgcattaaacagtttagccacgagagcaggattctcggtaattttctgtttcagtttcgcttcgtctttaatgacaagctttccttgatccgtataactatcagacgtctcaattccgaaatcggcaagctgatattttttcccgtcaatcgtaaccgttgagtacagatcaagccgcatctccgccaaaccgttctgcagcgtgctgtcgctccgtaataaaccgcttttggcttttgcctcccactgctcaatctgcttatcggtcattgcttctctttgttcatcggttagcggcttataatcacggtattttgattctgtcaccttctcatttgcgcttttaattaacgtattgtatttatcaacgaaatctttaatgttgttaaaaatgccgtccgtatcagtcgtgctgttaatcgtaaccgttttgttgctgtccgtcacgctgttcagcgtgtatttgatgccgttgatcgtaaagttatttgacgtttttgtcatttcaagcccgttgaacgtaaacttcgcgtttttcccttcggcattggccgtcagtgcatttgttgcatcatcaacggcaaaaccgagctgatctttcagaaagcttttggtcgcgtcatcacctgctgaaagggtaaacccttcccccgttttattggaagtgaacgcaatcgtgtccacataatccgagccgttagagattttctcttttaaagccgtcactccgagacccgagctgttcagtttagaaatgacatcgtcaatcgtatcggttgcggcgatcgtgacgtttacctcagtcggcttcgtttcccccggatttgtgacattgaatttcaatgtttggctttgacccgaagtgaaattgatggcccctgatgatttataagtcgtcggcgtagccagctgctgtacagacatgctcgttgaaatattctgttcggcactgacggccaccgcgctgacactggaatccgaacttgttactgtttttttattccagtttgtggacatcagcatattattaaatgtagtagaatacatgtcggcaatctgggtattcatttcccgataagcatcgcgcttccattcaagcgtctgcttttgctggtttaatttattaagcggctgcttttcggcatccatcatttttttcaccagagaatctacatcaagaccggaattaaggcctgtgattcttgtgaccatatgtaccctctccttttcggcgtttagtcgtagacggctctatgacaacagtgagtttccgactgtttatcatatcacagctccataaatgtatgatcttattcttatatcggtcatattaaaaggttttcaataatttaactgcaaaatataatgtttcattttgtcaatagggttctttggcttgctgaaggaggagttagctgaagaaataaaaaaaagaccctggagaaccaggatctttccgtcattaacctttaagcaattgaagaacttgctgaggctgttggttagcttgcgcaagcatagcttgagaagcctgagtaaggatgttgtttttcgtgtactccatcatctcagaagccatgtctacgtcacggatacgtgattcagcagaagtcaggttctcagaagaagtaccaaggttgttgattgtgtgctctaaacggttttgaaccgcaccaagtttagcgcgctcgctagatactgtgtcgatagctgttttgattgttgtaagagctgaagacgcagctttagctgaagaagagatgtcgataccttttgttactttagaatctgcagctaatttttcagatgcaataactttaccgtcagtatcataatagccggctgcttttgtaaccttaccatctggatctgttacttcatccgcccaagtagcagtgctttttccgtcagttgatgtcaatgtattttgatcattggatactgtataagtcgtaccaactttcaggctttcagagtccattttattgatagacaggctcattgtttggccttcgttagctccgatttggaacgtcaggttttgcgcagttccgtcaagaagtttcttcgtgttgaactcagtgtcagtagagattcttgttacttcagacgctaattggtccatctctttttgaagctcagaacggtcagaatctgtgtttgtatcgttagctgcttgtgtagcaagctcgctcatacgctgaagaatgctgtgagtttcgttcaatgcaccctcagatgtttggataagagagattccgtcttgagcgtttttagacgccatgtctaaaccgcggatttgagaacgcattttttcagagatcgcaagacccgcagcgtcatcaccagcgcggttgatgcgaagacctgaagataatttttccatgttttttgcagcagagtttgaacctgcattcagctgacggctagtgttaagagccgcgatattgtggttgattctcattttgtatttcctccctgaattgtttttcgcacgtccttgtgcatttgcgcagcgtcatttctgaagaaaatttttcctctcattggctacaatatatatatcggacggccgcttccattgtttatattgaaaataaaaaaatcctcactttttttgtgaggataagttaagtaataaatcagtattaaaagatacggctctgttgttctcttccaggatcgacaagtagatttctttccggtgaatatctacgtgctgaggcgcttcaattcccagcttcacttgttctccttcgatagcgatcacctttatttcaatatccggcccgatctgaatggactcattcacttttcttgagagaactagcatgatcctcctcctatcagatgttttgtttcataggaagcatcatgtaaaatgatttgtttcgccttcatttcctttttattgacgataatcggcgcttttaaattggcggtcgtgttttcaaaaggctcttccagcgttaaaatcgccatcacttcgacgtcctctatatcttcaatatgcaaaagctcaagcgtcgcttggtcaatgtcaaattcgtaccctttaaagaaaataaacggactggcgacaataaaggcgatgtgctcctgtttcacagactgcagcgccaaaaacggtgaatcttccgacaaaggaagaacaacaaattgagtctcgtcattaaatcccggcaggccgttttcaaatgagataatctgcccttcatctattctgatttctccgtgatattttgttttaattatcatccttcacaatcctttaccactttcatcttttattctgcgttgccatcatcaaccgaaatcgtcaccttagggtcttgcatcatatcaatctgaactttccccggcgtataattccatacaggtttattgacagctgcttcaattgaaggtttgcgggcttcaatatcaatcgtaagctttgaaggaatgcagtcaatgtcgacgagaaactgcgcaggcagaaagtcgctgaattcgccgaatggatcgggcggactgacatctgctgcctgccgggccatcacattgcccgttttcttttcgatagccgccatttccttcccttccctgactgtttttgcgataaactcgctgcaggcttccgcacctttttgagcggcttcagcgttcagcttttcaaatgatttgagattcaagttctcccacgccctcgtctggtcaatcgtcagtttggccggcgtgctttcgatgttcagctctgccggcggctgctcgatttccaggtcagcgggcggctgttccatctcgatttcttccttttgaaaggttataccgattttagcaggcacactgtcaataatcaatctcggcatctgcacagagatccctcctgtttatagtattttagtaaaaaaagcgatctccctgttgtgagtcgctttttttatatattgaagacgatagttatattatttcaggaagtcgatcagtgacggctgaatgatattcgcattcactgacagcgctgctctatgaaccgtctgttgagataaataatcaacaattacatcttccatttctacatcctcattatccgacaatactttttcagcggttgccgcttgtgattccaatcttgtctgaatgagttccaaccggtttgtgcgtgcgccgatattggatttttcagcattcattttgtcagtaaaaccgtcgatatctgacagaatttgatttgaatctgcttcggacagcgtgcctttgcttaaagaagcttctaaggagttgagaaattcaaatacattatctccattttgtgcgacgcctccgaaagctgagtttggatcagaattcactttcagcactgctccgtttgagatgttgatgttaacatccgaagcaccggtataattctcatagttgtacgtatatgtgccgtcggcattttcagtgatcggcgggacatctgaattcgttccgttaaacagataacgtccgtttacctgagtattcgcgacagaaacgagctgctttttcagctggccgatttctgtaccgattgctttcaattctgtttcaccgttcgaatcacttttcgcctgaaccatcaagtcccggattttccccataatatccgtttccgagtttacgcttgattccgagttttccagccatgtaaaaccttgcgaaacattccgttggtactggtttacctgcgcaagctgagtacggtactgcattcccttcattgcgacgaccggatcatcagaagctttcgtgatttttttccccgtagacacttgctgctgaagccgatcgagcttgtcataacttgagccgataaatcgaagagaattttttgcgatcatcccttgagttactctcatttacttatctcctatcttcctccggtgcccataccgttaataattttatcgaatatttcatcctgcatcgttatgatccgcgcagccgcattataagcgtgctgaaactgaatcatatttgtcatttcttcatctaaagacactgcactgactgattgtctccgttcatcggctgaaagggtgttgctttcagagttgttcataagattagccgctttttgtgaattaacgcccagctttccgataagggattcataaaagtcattaattgtagtggtttcaccgttaatagtcagcttgctgttctgtacggctgcaagatttgtcgcgtttgtgccgtcacttttttctccgtttaacgacgctgcgatattatcagtagacgcaaggattttgtcactgacttttattttcgctgccgcaccttttgccggcaccgcttcatcaccgctgaaatcaaaaaatgctgcaccctgttcgcctgtataggtcttccctttttcatgaactgcattaaacgcgtcagcaaaggatagcgccatattgtcaagagccgtcagcatttcaggataaagccctttttcttctccgtttgacatatagccgtatgattcaataagacctaaaagtgagccttttccggtaaatgcatccgcattgaccgtactgctgccgactgacacactcgacacgagtccgctgtccttgtcgtagttgattttcatttctgaaactgtttttgtgttaccgtcgagcagcgttccgagagaattgttgttcccgttcagcaattcgacgttaaccgtgccctcagcagtcgccaaggcatgtccgcccgacttattatatgaaacttttatatttgccatagaagataattgatcaatcaatctgtctctttggtcatacaaatcattagggagcataccgctcggctcaactgccgctatttgattgttaaggtcattcagctgattgagaatggaattgacctgatcagctgtgttatccaggttctttttaatatcaccctgaatgttagtcaaagaggtagatatatagttaaaactttcggcaagagatttcccctgctcctgcaaaactgagcgcgctcccgtattttccggattcgtcgccagatcctgaagggcattccaaaatgaactgagcgatccgtttaatccgttattgtcaagctctttcatgacgccttccatttgcgacaatgaattggaacgggctgtatagtaccctaattttgtattttccgttctgtactgatagtctaaaaaactgtctctgacgcgctcaactgaaccggcttttactcctgttccgatttggccggccgtcagatcactgttttttgatactgcgggataagggctcgtcgattgtaatgtgacgcgctgcctcgtatatccttctgtatttgcatttgcaacgttatttgaaactgtgctcaatgcagtctgctgcgcactcaatgcacgccttgctgtttcgagccccataaaagtcgatggcattgaaaatcctccgttctaagcttttgaatcgaataatgtcaaacggctgacaggcttgcgcgccgcttgcggctctttataattcatattctctttttcacccggcatgatcatatcgaatgccccggagatgaattgtaaagcctgaatcgtgagctgtttgttcatctcattcacttctttcagacggtcaagaagcgcagacagagagtgaaataacccttcaagctcctgtttttcactgcctgaagttctggagatgcatgcagcaattgtattgtcctcaccgcggctgagaaactgagaagttaacctgattcgttcttcctcagtctgcccgattgcctgaatatacttttgctctttagtcaatatgttggagagctcttttgttttacctgctttcagcgcttccgttttctcctcagacagcgtgagcagatgttcatgcagtgcgcaaagtcgcttcagttgatcaataattggctttgcagacattgactttctcctttttattgctttttataaaaattcactatgttttcagcgatgctgtttgaatctattttatatgttccgctctctatatccgctttaagctgagcgattttttcctgacgtgttttagtgaccgcatctgacgcattttgaagctcttttgcatgagaagaaatttccactttgtccttcggctttgcagcctctttttgtacggcttgcttttcgtaatttttttggtatggattaacggattgtgttccgtactgattgattttcataggattcctctcgctttctgttcgcagtctaattcttttatcgactgcgttatcagttagtttagggaatcaggtgtttttggtattataggcatagtatgtgtcttttgtactgtttttttctttgaattcagcggctgttttttggttcatatggtctaattgcgactcaatatctgtctgacaggacttgcaaaattttcctgtcctgatcggatttccgcacctttcgcaaggatatgccaaattcggaagctggctgatctgaatccttttttgtttgataaacttgaggatcagctcttcatccacacctgtttcctcagtgatctgctgcatcgtcgactgtctgttgatctgctttctcaaaaaattatagacggtttcaaatgctttttcttcttctttaatacatgcctggcacacggtctgcaggttcgttttaaaaaataaagcattgcattttggacaattcgccaattcacccatcgtattaactcctattccttctttaatctgccttatatttctatcaattatatcggcagaaaaaaagaatgatttagctcctgattaaagtaaaagaggagaccgatgacgctttacccgctgtcagcaggacttcggcggcttgatgcagtgtggcgcccgtcgtataaatatcgtctattaagatgacgttcataccttcggccgagttttcggctgctgaaaactttttttctgcggacagcctttctgttttgctctttttggattgtttttcattgttcagtcggatgagggggaaaatgacgggcattccgagcagagaggccagcagctcggattgattgaatccgcgttccgccagccgttcgccgctcagcggaatagggatgagagtatgtgtatttgatggatatgccgctttaaagccggcagcaaagtcacgtccaaatgcttgaatgattttcgcatcacccctgaatttaaaccgggctaatgagtccttcatcgcatcattatacaaatataccgaacggttttgccgcagcaaaaagcgcttttccgtttttgattcccgggccgcacaatcagcgcatttttcatttgactcctgaggcctcccgcatatactgcatacggggccttcaattttttcgaatcggctgctgcatatggtgcatacctcttgctcgggcgccagagaaaacaaagatctccaagtcaatgaacttgaaattggtgagtcacacaataaacaattcagagatattacgctccttcccaagtttcacagaactcgcttggattaaccgaaacaatcgcggctgattcagccagaatgacaagcagcgccgtatttttctgtttatcaactatctctgcttttgcataagcaactttctttttatctgtaacatatgccggctcagcccggtttaatgaaagtgccagtacatcatttttgcatacccggcatgtgcatttcatatgaagcttaggcatatggcggtcgagaagttcctttaatatgatttctttagaattgacaagcatgctgacagctcctcataggaaagtatgagtatactgtatcatgttttctgaaattaactagtccaacaatttacttttttgtgccaatttgttcataagttctatatgtttttttgcttttttcattccgtttgtcattccgaaatgaaacaggacgacatcaccgctgaaatgtttataatgccttcccgttctgcccgcgatctgtacgagcgcgctctcagtaaagataggtgcttctgcgccgaggacacatgtctgaactttgggcacggtaacccctctttctaaaatcgtagtcgttaccagcagatcaagccggccgtctctgaatcgtttcactttatcctttctgaatgtgtcttccgcatgtacgccttctgcccgtatgtttaatttctgaaaataatccgttgtctttttcaatacgtgtacagacggaacgaataagaaaaccggcagctgtgattgaagtttttggcggacccaatccgttacagagcgcggcagttttcctttctgaagcttcttcttccaattgccgcaccacaaaaaacgcggctccggcaggggtttccgatgatatctggccggtatgcgaacgcttttcagcaaaccggcttcagcattcttttttaatgtgtctgaaggagttgccgttacataaacaagggcgctgtttttcttcctcgctttatcaacagcgaatcttaatgtctcatcggctgaaaaaggaaacgcatctacttcatctattatcatgacatcaaaaatgtctcggtagcgcatcagctggtgagcggttgaaatcatcagcggagtcaagcggcctttgtcctcgctgccgccgtacaaagcagaaacgtcgactttctcaaatgcttttttcagtctcggcagcagttcaagtacgacatctgtacgcggagtcgcgacacagacgcgcaaaccttgattcagggcaaactcgataccaggaaacagcatctctgttttccccgatccgcaaaccgcccatactaacagctcttgtctctcttttatcgcatctgtaagcgcggcggcggcctgcttctgtccgtctgtcagtgttccttcccaagaaagctttacaggctcccagctgttttcaggggcttgattccaagaatataatgatgtcagttcatcagcccttcccatcatgacacaggcacggcaataggtaatctgccttttggcagagggcgcccaaaatgccgcaaagcaggcttgatcagactgaccgcatcgttggcagacgtaacggtttttccggcggatgattgacggctcggccgttatatgctctttttctataaaacggttgatgcgctgatctgaaaacggtatctcagatctcaataaatgccggccgtaaaagaaatcccgcacctctgaaaattctgaagcaccttcggacatctccctgcctcctttctgttcaaagtatgcctgccgggaatttttttgtcgaatcacgaaaatttaataataaaaaaatctccgcccttgaaaacggagattttcacttagtttttaaagcaccagccgattccgatggcgccttcgcccaaatgggttccgatcacggcaccgaaatagctgttatagaattcgacatgaggatatttaccgcttaactcctgtataatatccgccgcttcttcttccctgtttgcatggatgacagcggcccgcatcgggattcctttacttgcatcctccccaaacagttcaaaaattctcgaaatcgcttttttgcgtgtccgaatcttttcaaaaggaacaattatcttattgtcaaaatgaagaataggctttacctttaacagaccgccgataaaagcctgagcactgcttagacgcccgccccgctggaggtgtgataaatcatccaccataaaatacgcacggactgtttttttcatttcttccagctctttaataatctcttccggtgagtcaacaccgtctttaatgagctgtgctgcctttaatgcataaaaaccttgcgccaaacagctgatctctgaatcaaagggataaactttaatatgatcaaccatagtgtttgccgaggcggcgctgttataagttccgctgattccgctggacaaatgtatgcttatgactgcgtcatatgttttgcccagttcttcgtacaatgcgattaattcaccgaaagaaggctgggacgtagtcggcagctcatcatgattttttacttctttataaaaacttctccagtcgagttctgtttcttcgcggaatgttttttcaccgaaaaccacttgaagaggaatcatatgaatatgatgttcttctctcatctctttcggaatatatgctgtactgtctgttacaactgcaatcttcatcactttacctgccttattaagtacttaataagtattttaatagatatgaagctgtaaaaaaagacttgcctattatggcaagtcttctcatacatgactaacgcatctctacccagccgtttttaatggctacgacaacggcttgtgtccggtcattaacgttcattttctgcaaaatattactcacgtggtttttcactgttttctcactgataaacaatgattcaccgattccgcggttgctttttccgtctgcaagcatttgcagcacttcacattcccgtctcgttaatatatgtaatggtctccggatttccggataaacctcatgctgaggatgagcagaaactccgcttgtcgcaagacggcggaattcgttgacaagattgtgggttactttcgggtgaaggtaagaaccgccctcggctaccactttcactgcttcgattaaagtatctgcgtccatctctttcaggagatagcctcttgcacctgtttttaaagcatgagtcacatagttttcatcatcatggatggagaggataatcaccttagattcagggtacagctcaacaagctgtttagtagcctctactccatttacattcggcatattgatgtccattatgacaacatcgggatgataatgctcgacgattcgagccgcctcatctccatcgtcaccttctgctaccacttcaaaggtaggttcaaaatccaatattctttttacaccctcacggaatagttgatggtcgtcgataataacaatatttactttagtcacacgctacgcctccttatcctattgttctatatacgccgctgttcggtcaatatgtcttttggctctatttaacaaattataggccgagagataacggaaccttaatcatgataaatgtcccaagacctattttagagtctatcgttatcgttccttcaagcagatctactctttctttcattcccagcaagccaaatgacttgtttttcttttgtttagcatccttaatatcaaagccttttccgttgtccttaatgataagaacgacaaaatcagcggttacttccacttttactgttatttcctctgattctgaatgtttgagtgcatttgtgacggcttcctgagcgagacggaaaagcgccacttcaaattgcggggcaagccttttgttctccgtgtctccgatacactgaaaatgtattttcacctttccgttgtattcttcagttgtataaagatattttctcagtgtaggaatcagcccgagatcgtccaatgccatcggtcttaaatcatatataatccttctgacttcgtaaagggcattccgcacattctgccgaagatttttgatttcctgaaatccgtcctccgtgccgcggtcgcggaagatccgttcaattaattccgatctcatcatgacatttgccagcatctgcgcgggaccgtcatgaatttctctggaaactctttttctttcttcctcttgggcttcaatgattcttaagccgaaatcttgtttagcctgcgcatcggcaagaagaagccctacttggcgaaggtcttgattcaggtaattcagaacgacggttatttggctgaccaatgattctgaccgttcaatgatttcctgaagccccaaaagccggcgttctaaatcatctctgcgctcccgcagctgcttttcacgctgctggatcatcgtcagttccacttgaagtttgtgcgccttttcataggcgttgcgaatttcttcttcgctgaacttatggaaatttctgcttacttcagacaagcggtttcgtgcgtgccgcgtatgaacttcaagtttgtcccccagctcaatgacttcgtacacctgctgtttgatctgtttgagttcttcaaccagctgctcatattgctggcgcgactgctctccgatttgaaaaacctcgtccttgctcccgtccacggttttcagcattttcataagtatagaatccaaaactttggagtccatcttcgatttattcatctgtctccctccgtaacggtgttgttatgtatttttattataaatgtaattgaactgcaatttatgtcgaattataatgaaagaatgcgtatattctagaaaaaaacatttttatatagtatcttactctttcatgataccaaaatatgcgcaaaaattctaaagtctgttcgaatttgtagaaacaagtcttttaatgcttgtcaggagggtccagcaatcatgctgcacagctatttaactgttaaagaaacgggtgaacatgagattgtgattgaaaaatcacgttttatctgtcacctgagccgtgctgcttctgaagaggaagcgcaggaatttatacaaaagataaaaaaacagcactggaatgcgactcataactgctcagcttatctgatcggcgaaaccgaccatatacaaaaggccaatgatgacggagaaccaagcggcacagccggcgtccccatgctggaagtgctgaaaaaacgcggtctgaaagatacctgcgcggtggttacccggtatttcggcggaataaagctcggtgcaggcggattgattcgtgcatatgggaagtcagtgtctgaaggcttaaatcatataggagttacggagcggaagctgatgcggattatgcatacatcagcggattatacgtggctcggcaagatagagaacgaactgagagaatcagtttttttactgaaagatatccattatgcggatcatgtcgaatttgaaacgtacgttgaagaaaaagacaaagaagcgtttctaaaatggatgacagaactgacgaacggcaagagtaagaatacagagggagaactgacgtatttagaaacagacgtcagccctaaaggagactaatgtaatggctgaacgtgtaagagtgcgtgttcgaaagaaaaagaaaagcaaacgaaagatcatattcaaacggattttgctgctgcttaccctcgttttgttagttgctgccggatttggcggatacaaagtatacaaaacgatcaatgcggcagataatgcatatgatgccctttcccgcggagaaaaatcaaaattgcgggataaagtcatcaatatgaagaaaaaaccgttctccattttgtttatggggatcgaaaattatgccaccagcggaaaaggcggacgatcagattctcttattgtcgttacccttgatccgagaaataaaacaatgaaaatgctgagtattccgcgtgatacgcgggtgacgcttgccggcgacacaaccggcaacaaaacaaaaatcaatgcggcttttgctaagggcggagcggatgaaaccgtctcaaccgtcgaagacttattaggcataccgattgataagtatgtcactgtcgacttcaatggctttaaggatgttattgatgaagtaggcggggtcgatgtaaaagtgccgtttgacttcgacgagatgagtgacgtcagtaaaaagaaacggatctatttcaagaaaggaaacatgcatttgaacggtgagcaggctttggcttacgcgcggatgagaaagcaggataagcgcggagacttcggccggaatgaccgccaaaagcaaattttaaacgcactgatcgaccaaatgtccagagctggaaatattgctaaaatcgataaaatcgctgaaacagcgagcaataatgtccaaacgaatatccgaatcactgaaggactcgctcttcagcagatttacagcggatttaccagcaaaaagattgatacactgaccataacaggatcagatttatatttaggcggaaccgcaactacgcgcggaacatattatttccagccggatccaaccaatctcgagaaagtacggcaggaattgcagaagcacctggattacccgtccggaaacagcacggcatccgatcccgcttctgacagcaccggaacggacagtacgactgattcaacttccggcagcacaggaacaggcggtacggctgattcgacttccggcagcacaggaacaagcggcacaaccgattcaaccaacggtactgcaggtgcaaacggtacggacagcacacagtccggcggcacaacaggctattaagagtaaacccgatcctttgagcaggatcgggtttttctatataataagagaatagcaaaaaagcagaccattcgcatgatctgctctttttaatttttctttaccaatcttttgtaaaacttggtaaatggtttaaattgttcatttactaaccctgtgacctctgctatgatttgcataaatacaatcaatacaaaaataataaacagcgaaagccaaatggtcgcgcttttcagcaggatggcactgacgctgaaaataaagccgattaaataaatgataatgacagccgtgcggtgtgacagcccgaaggccatcagccggtggtgtatatgtgacttatcaggcgctgagatcggctgtttgtttaaaatccgcctgatgacggcgaatgtcgtatcaaaaatcggcacgcccaaaatgatgatcggaatgatgatactgaataaagtaacacttttataaagacctaataatgagagtactgagatgacgtatccgagaaagagcgatccggtatctcccataaatatctttgccgggtgaaaattataaaataaaaatccgagtgtgcttcctatcacgacaagtgaaagtgacagaataaggattttccctccggacaacgccataacggcgatagtggagagtccgatgaccgacaggccggcagcgagtccgtccaaaccgtcaatcaggttcatcgcattcgtaataccgacgatccataacacagtcagcgggtaagcgacccatcccaattctaaacgttccgttaaaaacggtacggagaaaaagtccattttcagtcccgtgctcacaatcataatggccacggccagctggacgaaaaactttacctttgcgcttaattggtatttatcatcaaggattcctaaaataacaataataaacgcacccaccgtaatggcggtcattttcgtttcattatatatgccggccgcgagcacacccgccgctacgccgataaagatggccaagccgcccatacggggcattattttatcatgtacttttcggttgctgggctggtcaactgcacctattttgatcgcaattttttttacgataggagttaggattaaaaccgttagcagagagacaaaaaacgcaacaactatgcgaaacatgcgttcgtcaagcataaagaagtctcctttggaattatatgaagtcttttctgatattgaaccgttccttccattataattcttactagttattataacaagcatcatcaaaaagaaacacgcaaatcaaaaaatgcgctttcccttttaatgggattgcgcattttccaatatacccgtgcattcaagcattcggccgaataaaacattccaatcccgtccccgggccaattcacggcgcaaagcctcgtatgatccgcggcggtccgctgccagaagcgcttcgcaggccgcgatgaaatctgcggggtcgctcccttcaacgtattcataaacgtaaggccttttgatttttgacgtagaagaaaggttgcagccgacaaccggtttcccggcggctaaaaattcaaaaagcttaagcggaaataccgcgtcattataaggtgaatttttatacggcatgatgccgatgtcgacaagctgcatataggacggcacttcattcggcgcggcaggtcccgtccagatgacattcgggcgttccagaagcgactcgaaatccggatcgtcctgagccgtgttcgggcccaccaataaaatcgtccagtcaggccgcaaatctgccgtttccgccataagcgcaaaatcgagctttggtttgattccgccgataaaaccgagaaccgttccgtttcgtccccgtaaaatgtcttcatccggctgtttattttcccgtgaaaacaggtcatattccactccgttttcaatggtgaacactttctggtgcgggttctccagcttttttccgacctcccggtgcagacagtcagatgtgcaggtgatggaatcggcacgctgaatgattctcatttccgcctgtttaatgatgtttcttcttacatttgacagcacaccggcccggccgctgatcggagcggcccacagatcactgcaatcgtaaatcacttcatcccaaggaaacagatctgccagaagcgggaaaccggggaaggtgtaccataagcagcagcgggccccttctccttcttccttcagcatgtgcaacaatggtgaaagtttatgcctgtaacacatgtctgtatacctgccgaaacggaatgctttttgctgcatgagatcctttacagtgaactgccggattccctcggcgatcccggccatctgatcatcattggctcgcggggacgggcatacccaaatgacgcttttcgtttctttttgccgggcaagaaattcagccagccgatgccgtctgtatctcagccggtcatgcccccattccgccgctccgacgattacgtgaataatcggttccaccttcatcacccagctcctctgacgcctacagtcttttcaagaccgcgtttttcgcatattgcataaaacaccacgaagccttgataaaatgcaggcgctcaatttctctataaacaaaccacgttttttttgcggctttccacttgttgcttgaaatcgaattctgcacaagcctgtattctgaaaggcactcattcaggccgtaagccgtaaatccccttttcagcagggaaagccatgtcgctaaatcctgccgcgttctgatatcaggcatttgaatctgccccgtctgctctctgtcaatcatgaccgttaaacatccgataatcgtgttttttaaagcttcatcatatgacaggctttcaggggcttgaatcgttttgtccgtcggcgttccgtcctgctccatgacgctgtagcccgtaaatgaaaaagcgcaggaccgctctgccataaacgcaagctgtttttgaagcttttcctttttccatctgtcatcgctgtccagaaatgcgacataacggcccttggcatgtttaagggctgtatttctggcagctgcggctcccccgtttttatctaaataaacgacgcggatccgctcatctttttgttcatattgccgtaaaatatctctcgttccgtccgttgaacaatcatccgcgataatcatttcccaatgcgggtggctttggtgtaaaacggactgaatcgtgtcttcgatatattcacttgcgttataagacggtgtaatgacagatacgaaaggtttccagtttgtcatggtcacatctccatcgcagatttttacaaggactctctaaaaaactcaggaatgacaatgaacataaaggcaactgcaatgccgattaaaacgcccagaaccgctttctttttcggcggcatgccttgaccagccgtttcattcatcggctctgaattgatgacgccggccgctttcaggttcagctgcgtatttttcaattcgtataaaaatcgttccttatccactttggcgtccgcgctgacggtttctccttcaagcgcagcaatactctgccgcactacttttgcccgtttttcaaacaggtcctgatcattcttcagaaaagttgttatgacggcttgaaacaccgattcggtttcctgtttgttttggccgctgcagctgaccgtgatcaatgaatctgattgtgtttcgacagtcagtttacttttcacggccgctctttcttcgtctgttttatgaggcagagcctgctttaaaaaggcatcgctcgtcaaaaggagcgggatttcttttgtattgttataaagcggatgatcataatttcccgcggcgatcgcggcttctgatgtaaaactgctgtttccgctgatttttgacggcaatacatatcccgccgcccctaacacaacgggcagcgcaatgatccaaatgatattctttttgatacgccgggttattcttgtcaacatatccttcatctcgcatctccctgtttttcatagtacgccgtgacggcaggctccttttgtaaacgcctcaatatattgaccgccgcgatcacgagcgagagaaatacccagtggaaaaataaattcgatacggagcttgggctgatgctgcttaccaaaaaaccggccatcgccgtgataagtccttctgtgatcagtcttgactgattttccgattttctttcatgacatttataaagtgtccaaaaaaggaacaaatagactgtcaggtaaccgagcatcgtaagtacgccgaagttcgccataatctcgacgagccagttgtgcacctcaactacgccgcccgtatcataaacgggctccgcttttaaatagtaagagacgtttccggcacccactccggacccccaggaatcaattacatagtgaaaggcgttctttaaaagattcgccctggcgaggttggaaggaagcggctgctgtcccggcatcgcctgcggagctgaaaacagattcaagacggcattggtgatacggcccgcaaataaaaccgcaaacagcgcagcacccgctcccgcagcgtacagcgcgaattttttcaacagagaaggcagcaggatgaagacgtatacagccgcccccgcgcatatgcccagcagactcgcgcgcgaaccggtcaaaatgattaaatacaaagcgcagatcgctaagagcaggctgacggccttcacatagccgtttttcatatttttcaccgccgccgcatacagaaagaaactgatgcacaaaaacgtcgcgaaatcattttgattaaagaaaacggacgtcggataatgctgtttgtactgcgggccgttataaagcgtggagctcggcagatggttgtgtgtaaaatggttgtaaaagccgatcgccatcacaaaaatggtcatcacaagccatatgccgtaaaaaaccatcagctgatcaaagcgctgaatgaacatgacaataagataaatcaaaaacatgcccattcctattaaagctaaatatttaatcccgtacgtcacggattttgcccacaataacgataggagaccgtatgtaaaccataaggcgaaaaacatcagaaccccttttacattcacccgattccatctgtcaatatgatgacggtttgtcaggatgccggcgatgtgtagggcgcccgctccgattaataacagccggtatataaataagctgaaaaatccgagatgaaccgcaaagaaggcctggtttaaaaatgtacacgcgatcagtatataaatgagccccataaacatctgaccgtttgttgtaaaggcggatagcaaagcaagtccggcaataccgatcatggcggcaagcagcagcacggtgatttttccgaggccggcatccgccctgaccgcctccagcatgatgaatcctcctgtaatgacagcggcaagcagcacaagaacatgtgccgctgaacgtttgatactcacatggcaaacccctttccaaaaccggcagccgagccgggctgccgagagcctgaagacaaatctttttctatcttgccagttcttttatttgccgatcggcatgaaccgccggacgtccgacggaatgataagtgaatcctgaaaccctcatatactccaacggaaacatatttctgccgtcaatgatgaccggctgtttgagcagccgcttcactctctgaagatccatctccttgacttccggccaatctgttgtaatcaggcatgcgtccgcgtttttgatggcactgtacatctctgcgtgatattcaatgccgccttctcctaatatcgctgccgcttcgggaatcgcgatcggatcatacgctttcacgtgagcgccctgctctttaagacttgtgatgatatcaagagccggggcggagcggacgtcatttgtatgcggtttaaaggccagccccagtacggccacggttttcccttttaagggaccgatggcgcggttcaatttttccgtaatacggaccctttgcttctgattggtttcaatgacggcttccatcatttcaaacggatagccggcggcgtttgcgatatgcaataaagccattgtatccttcggaaagcaggatccgccgaatccgatgcccgcctgcagaaatttattcccgatccggctgtcaagaccgacgccttctgacacgtgagaaatgtccgccccgacacgttcgcaaatattggcgatatcgttaataaaagatattttggcggctaaaaaagcatttgcggcatacttaatcatttccgcgctttcaagattggtctttacgatcttcgtacggaacggcttatgaagctcttcaatgaccgaagcggcatgttcgcttgtggcgccgataaccgcccgctccatctgcatcgtatcccgcaccgccgaaccttcgcggaggaattcaggatttgacgcgacatcaaacggatatgttccctttgacgcttcgctgacgatttggtaaacgagctttcccgtcccgaccggaacagtgcttttggtgacaatgattttgtatccgttcagctgttctccgattgtttgcgccgctgccttaatgtaggtcagatcggcttcacccgtctttgacatcggcgtaccgacggcgatatagatgatatcagcggctttcacagccggctcaatatcggccgtaaaggataaccgcccgtcactgacatttttttcggctaattcctcaagccccggttcatatatcgggatgactccgttttgcaagcttctgattttcgcttcattgatgtcacagcaagtcacatgatggccgatttccgcaaaacaagttccagatacaagacctacataccctgttcctaatacagcgatttttttcacagcttcatccctctttcgaaaggttctcctcttgcccggaccggttcatgacggaccggtatttctctttcagcgctttcgcgttttggcttgcgtcaaaatacgtgcggacggtttgataaagttcctcggctgtttgcggcgtccaagcctctccttcgtcatattgcagaatggattctgccagcgtgccaggtgaacccggcttgatcagcaaacctctatatttcccaaataaagaagccaatcctccgacatcggtacagatcaccggcaccttcagagcgagcgcctcaatgaccacagtcggcatgccttcgctgtaggacggcagcgccattacatccgaggccagcagatagtcctgtaccttgtcgttcggcacttgccccgtgacgatatgagcggcttcacgcaatgaagatgcggctggaccgtcaccgacaaagacagcttcatatctttcatccaatgactgaacggcttttgataagtcgaaaacacctttctctttgacaagcctgccgatgaacacgatcagttttttatccggaggaaggccgagccgttttctgacggcttctttcgtctcgttcctttttcggaaggcgtcaagcgtgatgccgatcggaagcacgctgcactccgcttcgatgagctttttcatttgttcccgcagactgccgctcacagcgtaaatatcggctgcttcccgcaccgcaaatgtaaatgcgcgatgagcgcttttgctgtaatgcggatagacattgacatcactgccatgcaaggtcagcacatacgggatgcctaaagcctttgacacaatggcggccgctccgcctgacggcatggcgaaatgcgcgtgaatcagatcgggcttcaggccatgatttttaatttcggaaagaaccgatgacgccattcttttatgcggctgcgcccatttcagctgcccgggaaccgcctgataaaacggccggtggacggacacgcctttccgccattcatgcgccggccttatatccttttgccgatacgtctttttcagcacccggaatggcgcggcgagtttcggccggggacaaatgacagtcatctccgcgccaagctttctcagttcttgggcctgcgtctcatgaaaaacgccttctcccggcttctcactgctcggatatacacttgtcatccacaataccttcatagcaaacgtccttttcttaatttacttttcatatgcggataagcttttcctaacaggaacaaataacacaacgctccgcaggatacggagatcgccagccgcagcttgacatcaaggctgatccgctccgtcccgaagctggctgtaaaggcgatgacacccattgccgccgtaagcagaaacggtttggccacggctttgaagtaagccgacagccgcagcttaatgacatatgccagcagccagcgcccgatcaggaaattcaggatgctgatgaaagcgtacgtccaggctaccgtcaagagatttccggacagcacggcggcgtacaaagatgcaccatacagcagcatcaccccggcgtcccaataaaatgccagatcggcccgcccttttgccagcagcacagatccgttcggattcatcagaacccttaaaatcccgacgatggcgagaacgtttaaaaccgggacagccgccagccatttttctccgaaaaccgaagccacgaatgcatccgatactgaaaccaaaccgagcaaaagcggaaaggatatcagcgcgagtattttggtcatattgagaaaaccttctctgatcacgctgttttcatgcttgtttttcgcaaagacgggaaacgcgactctcgtaatgatcggattgatttttaataccggaagcgtgacaatctggtaggccagattgtaaatgccgagcgcctcggcgccgataaaactgccgatcagaatcatatcaatattcgccccgagccggttcacaagccgggaagacagctgaaaggctccgaaagaaaagaagcctttcattcccttcagatcaaaaacgaacaccggtctccatgtttttctgcaggacacccagtacagaataccttttgacgattgcagcagcacctgggaaatcacataggcgagaatcgggtccgtataaaaaaccgcagccgccaagtaaacgaaggacagcacatttgaaaagatttcaatcttgcttagcgtgttaaatgccagcgctttttgcagcatatattgatattgctgaccgatcggcgcgattaaaaacatgacggccagcacgcggattaaatagacaagctcctcccgccgataaaaatcggcaatgagcggactgctgaagaacagcagcgcaaacagcgcaagccccgttatgatattcagccagtacaaggaagacatctgtttatcagtcacatgatctttttgaatgagcgcggcgccaaaacccatatcaagcgcaatttgggcaaacaccactaccgttgtgatcatgccgacaaggccgaattcagccagtgacatgacccgcccgagcagggcgaattggacgatttgaatgaccgtaatacacgctgtcgaaatacttgtccatttggcgccgctcaaaatttgatttgtaatactaggcatcgttttccctacttttttgtctgctgaccagaatttttatcgcgccccgtcaccggtccagatcactttgcacgttttgagcataatcttcagttccaatgaaaaggtcaggttgcggatataatataagtcaaacatcagtttttccctcggtgtcatgtcatatcccccgttgacctgcgcccagccgcttaatcccggcttaacggccagccgctccgtaaaccccggaatctcagcctgaaactgttccgtaaacacgggacgctcgggacgcgggccgatcaggctcatttctccccgaagcacatttaccagctgcggcagctcatcaatacgggtccttctgataaaagcgccgacctttgtcacgcggggatcctttttcagcgcccagaccgcccccgatttttcagcatctattttcatagagcggagcttatacaaataaaacggcttcccgtctttgcctacccgctcctgcttgtaaaaagccgggccgggcgactccaaacgaatcagtatggagaacaggcccatcaccgggagcgccgccaaaagccccgcaagcgcaaacacaatgtccatgaatcgcttaaaagccaaataacgggccgttctttccgtaacggcagcggaagtcccctgccgcactgcatagttattatttacattcatgcttttctctgctcccactgacacacacctcacgatttgttgggatgtttgatgacctatgccgtgagtttagcagatggatgttaattggaagtaaaggaaacgttaatgtttattagaatgtttcgattattgtttttttattgtaaatctattcatatccatatttgagacaaagcataatgaaaaaataaaaaaacagaccggtatgaaccggtctgtttccatgaaaaaaattatctgaaataggaggaaacgccttgggtgatccccgccgcgagtctgtcctttttcgttgattgttttagaatattggcatcaatcgggcttgtgacaaaaccggtttctaacaagacactcggcattttagaatacttaatgacgtaaaatccggcagttttcacactgcggtcacgcgtgccgagagcagaaaccattctcggctgaatattttgggcaagcctcagactgtttgccgattggtaggttttatcataatacgtctccgtaccgtttgcactgctgttatcattcgcatttgcatggacgctgatgaaaatatcggcgttcgccttcgcccctttgttcactctctcctcaagcgaatcaaaggtgtcgccctttcttgacattacagtaagcgcgcccgcgccgtataattgattgttaagacgcgtagcgatatcaaggtttacatttttctcaagcaagccgtttccggttgcacctgaatcctgatagccgtgtcccggatcaataaagaccgttttgccgacaacgggatttttaagctgcgacgcggcattgttgcttaaagatgaagcacttcctatgacggtgaagctggtgatgtttttacttccgatatacgtccggacgtcttttgacagactgtctccattcgtcagcaggtgaactcttccctgtttggcgctcagcacgcctccgacgatggtatccgcctctttaaagccattggtaacaaacgtatagcctgtgcttaagcctgtcttttttgcaagattcacagacaggttatagcggtttttgccgctgattctcgaagggttcggcagcttattataaagtgagctgctgatgctgcttgtcccgccgatgacaatcgtgtttttaatccctaagcttttgatcgcattggacgcagaaccatttaacgttgaatcattagtgaataaaatcggatattttttagcggacgcataagaaatcgcagccattccatccgcatcaacaaacccgttgaccacaagggctgtagaagatcttgtcatttcacccgccacttttgcggctgtggcatatctcgtgctccctgataaccgtttgacactgatgcctaatttagcaatttgatttgcggtatttttcgaaacggcaggtgtgccgcctacgataatcacatttttcgtttttaaatcaattaatcccttttttgtgccggcagacagctgatctttatttgtaaacagcagcggcgcatttttttgatatgcaagcggcgcagcggcaattgcatcggcatatgaagttccgccggtgataattaccgttttcgcttcaccccatgattgttttgccgccagtacagccgtatcataccgggtgcttccgccgatccttttaaccgtgttgtcagccaaagcggaagggacaaatagaatgaccccgagaataaagacggggagacattttatgatgaatttcaatccgatctcctccacagaagtttagtagtttgtaagtgctgtattaggataatagaacgcaagaatagaagtatacggctctccggcctccgctctttcttttgctccgtattgactcattcctacgccgtgaccgtatccctttcctgatatcgtgatttgcgaagaattaccggacgcactggcgtatgtgcttttaaaagatgaagctccgatcatcgtcctaagttcagacgctttcacctcaacagatgcagtcttgttcatgacatagcccttcgacttgtcattcacatggtacgtgaccttcaccgcggcgtcttccgcgcgctggccttttgtttttccggtgagcgagagatcagagatacttgcaatttttatggaacttgcattggtttctttatttttcatcagccaattttttattccgttgagctgcgcagcatttgcttcgtttgttttagaccaccaggatgcgggatttttcatatccagacccgctggcagctgctgcttctgcaatgttaaagaccagctgatttcgggatcttttgtgtcctttttggctactaaatacggcactttcgatccccacacttcatcgccggcttccatgtaaccgccattgcttgatgagtaagtggcatctatcaatctgccggaataagtgagcactttcccttttgttccgttaacggctgcggtggcgtttggataccagctgtatcccccgtaaacctgaaaggccgttgtatccgcgactgtttgtcccatcttgccgatagagtaggtgcgggcggcaacagcctgggctttcagcgcttctgtcggccagcttcccggcatttcattcggcaggacacctttcagataatcctcaaaaggaatgttttcattaacaggtcttacatatttgccggattcagcagtgaaactcatattccccagatatggcttcccgtcaatgctgattgtgtttgctgttgaatatttttcaggaaccgccttgaaagacgtttttccgctgttaatgcctgcaacgcctaatttgccgccggacgtttcaatacggtacgtctttccgtttacgagataaaactcttttgcgtaagcagccttaactgaatcggcaattgaattcgcgctgcctattaatgtataagaataggtgcctttcgttttaaaaaggccggcctcgtcggcgggtgtttcgctttttttgatgtatacaagcggcatgtgatttgcggcggcaatatttgatccgactacgatgtccgctaatttagtcccgttggcagccaccgttttgcttgcatccatgccaagcgaagtgactgcgtttgctgatatttgatatctgtttgatccggtaattcgtttggtgaccgaggccttctttttaatttgattctccacatctttgctgacgcttgaagtgcctcccatgatgatcacttttttaggcagattgtagctcggaagggagtcttttttcgtcagaagaatcggatagccgttttgcgcggcatatggcgcgattgccagcgcatccgtatatacatcccccgttactacgaccgcctggtcatagctgcccatttcggccgcaatatttttggacagatcatatctgttttttccgctgatccgtttcgtacggccgtatttcttcaatgtcttttccgcggctgacgaaatactgttcgtcccgccgatgattaaaatattatccggattgaatttcttgatttgcgcttctgtgctgctgctcagttttttcgcttcagtcagcagaacaggcgctttcagtttattcgctaaaggaatgacggaaagcgtgtccgcaaaataagcgtccgtattcacgacgactacgttggacgggtttttccaatacttagatgtcgcggcgttagccgtatcatatttggacgcgcctcccaatctgacaacggaggacacatcgcttcccgtcagtttataagttcctgaaggttcgatattcagagtcgatttattaccaatataattcgtcagttttactgagatatcagaactggccgcaaaagtgctttccggtaataaagccaggctgaatatcacagaaaaacagacagcccatattgttttcttcaatttttatcccgccttttgctgatcatggtgtattattttgctttctcgatttccttgatctctttttggcctttatcatttgtgaaataagtaatgctgactttgtcattttcgctgaatttattcagaacatcagagaagtcatcagaaaattcaaagctgacgggctgatcatccacttttacttcaattgtgtgcgtatccgccataccgatataatatgccgtttctttttgagcctggttctccgaagaaccgcttcccttctttgattgttccgccgttccgcacgctgccaatacaacagaaaaaagcagtattaagaacgaagctgcaatagtttttttcatttttttcacctcatctttatgtatcgtcttatactaactttttttaaggtaattttaaggtctttttgtaaccttttttttaagaatttcgtctattacatggttataagtaaaaatatgactgggtttataaagattagtaaattgcatcatgaaagttaatagaaaaggtgatgacaaatgagagctgaacgaaaaagaaagaagaaaaaggttcttctgacaatcgtaacaatcatcgggctgttagttttatcatcaggaggctacgtctactacttgtggcacaaagcggcttcaacggtggcaagcattcaggaagacttaaaaaaatcggacaaacgtgacacggatatagatctcggaaagaaggatccgatttctgttttaatcatgggagtcgatgagcggaaaaatgacaaagggcgcgcggacacgatgatttatatgaccgtcaatcctaaaacgaatacaacggaaatggtcagcatcccgcgcgatacgtatacgaaaatctccggcaaaggtacgatggataaaatcaaccactcctatgccttcggcggaacccaaatggccgcggataccgtcgaggacctgctcgacgtgccggtagattattttgtgaaagtaaacatggagagcttcaaagataccgtggatacactcggcgggattacggtgaacagcacgttcgccttcaactacgacgggcattctttcggaacggggaacatcagcctgaacggcgaagaagcacttgcctacacccgcatgagaaaagaagacccccgaggggatttcggcagacagcagcggcagcgccaagtgattgaagggattatttctaagggggcaaacatctcgtctgtcacgaaattcggagatatgtttaaggtcattgaaaacaatatgaaaacaaacatgtcattcgatgatatgtggacggttatgactgactataaaaatgcccgcagcaaagtcactcagcatgaactgaagggaacgggaacgagaatcaacaatatctattattacaaattagatgaagcaagcctcgcttcagtcaaaaaagaattaaaagaaagcctgaaataataaaaaactctgcatatgatgcagagtttttttattctgtaaaaggctgcggacgggtttttctatagccgtaccgataaagcagttcttccgcaatccgttttgaggccgatccgtcaccataagggtttgacgcctttgacatccgttcatactcggcctgatcggttaagagctgttttgtcagctgatacaccgtttcttcatctgtacccgccagcttcaatgtcccggctttcactccttcggggcgctcggttgtgtcccgaagcaccaagaccggctttccgagagaaggcgcttcctcctgaaccccgcctgagtcggtcaaaatgaaatttgctttcgcagcgaagttatggaaatccacgacctccagaggttctattaaatgcaccctgtccgaatcagcaaaatgggcttctgcggcctcacgaactgcgggattcaaatgaacgggataaacgacttgtacgtcctcaaactcttcaacgattcttctgacggccttaaacatctgttccatcggcctgcctaaattttcacgtctgtgcgctgtcaaaagaatcatcctgcttccttccagcttgtcaaaaatcggatgagaatagtcttcccgcactgtcgtttgaagcgcgtctatcgccgtatttcccgtgataaatatagaatccggctttttattttcagcaagcagattctgttctgcctggcttgtcggcgcaaaattcacatcagcgatcacgcccgtcatctgccggttgatttcttcagggaaaggagagtatttattttgcgtacgcagaccggcttccacatggccgacggcgatttgatgataaaaggcggcaaggcttccggcgaacgttgtcgtcgtatctccgtggaccaaaacgatatctggttttacttcttgaaacagcttgtccagtttcagcaaagcatgagatgtaatttctgaaagcgtttgacgctctttcataatattcaaatcaaaatcaggcgtgatgctgaatgcttcaagcacttgatccagcatctgtctgtgctgtgcggttacagtcaccagcgaatcaatttcctgatatttttcaagctctaatacgagcggagccattttaattgcttcaggtcttgtaccgaatacggtcattacttttagttttttcaacggtttgtctgcacctcgttttatatgtcggatatcccttcatgttaacatatttatgccgtttcttaatattgtaaagcttaatggcaaacaaagcaaaaaccgttacaagactctttgaaagcggattaaaaggtgtgaattttaatcaattgtggtaaagtggaaaaagactaggttatagttctgaaaaaaagattttgcagaaacaaggatggtgttattcagtgaagaaagtacgcaaagccattattccggcagcaggtttaggcactcgttttttgccggccacaaaagcaatgcctaaagaaatgcttccaatcgttgataagccgacaattcagtatattatcgaagaagctgtcgaatccggcatcgaagatattattatcgtaaccggaaaaggaaaaagagcaatagaagaccatttcgacaatgcccctgaactggaacgcaatttagaagaaaaagggaaaatcgaactgcttcaaaaagtgaaaaaatcgtcaaatattgcggatatccactatattcgccaaaaagagccaaaaggactcggtcatgccgtttggtgcgcacgcaacttcatcggcgatgaacctttcgccgttcttctcggcgatgatattgtccaggctgaaaaaccgggacttcgtcagctgatggatgaatacgaaaaaacattgtcttccatcatcggtgttcagcaagttcctgaaagcgacacacaccgctacggaattatcgatccgttaacaaatgaaggccgccgttaccaggtcaaaaattttgtagagaagcctgaaccgggcacagctccttccaacttggctattttaggaagatacgttttcactcctgaaattttcatgtaccttgaacagcaggaagtcggtgcagggggagaaattcaattaacggacgccatccaaaagctcaatgacattcagcgtgtcttcgcttatgatttcgaaggaaaacgttacgatgtcggtgaaaaactaggatttatcgagacgacgcttgaatttgccttacaggatcaggatatccgccataaattaattccgttcatgaaggatcttcttgaaaaagaagaagctgacgaatagaaaaagctgccgaatccggcagctttttttatgtgatctttactttttagacgttaccgtcagtgtcttatcagcattgttcacagaaaaagtatattcctggtttttaagcatgagcaaattctgattgattttgctgccgcctttttcacttaaagctgagatgtctgcaggacgcgataaatgaaaaaccacttcggagactgtatcattgtcaatcactacatccgtttttgcatcggatgcttttaatacgttccgtccgtcagccgtttgtcccgcagctggatttttcaatttacgctgcacatcgtcccggcttttattgagatatgagagaaactcttctgctgtttggcttgataaactgccgctgaaatcattcagctgaacatccgtcttttttaaagcgttcactttatatagatcagtctttttcataaagtactctttatcgtttaatttcactttagccgcctggttattctcggcttctatctgcaccttcgtaccgaaacttacacttgcggaggcttttccttttatatctttttcagtgtaaaggtccgccttttcagcttttaccaaagcaggtttattcacagactcataaaggccggcatcgctctgtttgacgtcaccgaaagatgtgatcgcacgcagaggcttgtctgaaaacatcgaagcgcctgcgccgacagccagcaatgcaagcagcgtaatctgtatcgtattggcaatgaatttaggcttcgctttcttttgctgggcctgagtgattttctgttcctcggctgcccgcgttctgccttcaatctgctcgttttgatatttctttttttctttctttgaaagcttgttgaaccaatccacaaaagctttatattcttttacaacggctttcgtttcgtcgaacatacgcatttcgccgtaatgcatccaagccacccggtcacacattttctcaatctgtccgatggaatgactgacgaaaaagatcgttttgccgcgttctttaaattccgtaatgcggtccacacatttctgatagaaagtctggtcccctactgagagcgcctcatcaataataaggatgtcagggtccatatgcgccgatatggcaaaaccgagacgggatttcataccgcttgaatagcttttaacaggctgatctataaagtcgccgatatccgcgaattcaacgattttttcataaagctcgtctatctgccgattgttgagacccatcatcaagcactttaaacggatgttgtccttgccgcttaattgattgtttaatccggcagaaatcgcgattaaagacggctgcccgttcatatcaatctcaccgcttgtcggcggaatgatctttgcaagcagattggacatcgttgattttcccgagccgttgatacctacgaatccgatcgtttccccttcatagacgtcaaaagaaacatttcggacagcgaaaaaacctttttgatttctgtttgggaaaaacaatcctttaattttgtcagactgttttttatatagaaaatactgttttgaaacatttctgaacgaaacttttagtttcatcgtataatctccttactatattaaagaaagtcaacaaacttatctctgaatttcatatgaagaagtgaaccgactgttaacagcagcagtgtgacgaaccagaaatacagcgtgtatttcacatcgtggaaaaaccactgcccttccataaagctgtctctgaagccctcgataatatagaaaagagggtttaacttcaagatggtcaaaacttcaggtctgtttccaaatttctccgcaatgtcccagaaaatcggcagaagaaaaaagagaagccttgtgacggcttgaagcaaaaactgatagtccctgattaatacgctgatggttgaattaaacaggccgaaagcaaacataaaactgatcatgcaaaacaagtaataaatatattgcagccagtgaagcgtcggaaacagtccgttgctcagcagcacaataatataaatcgccatcatcacaaagtaactgaataaattcgatgctatcactacagaaggcagtgaactgatcggaaagttcattttcgacactaaatttatccgtttaaaaacgctgttagatgcatccagtatcgtcggactgataaagaaccaaggaattaagccggccagcatccagacgatgaacggtacgctgtctccatttccaagcaccatatcatgtccgccgcgaatcccgaggccaaatacgaaccagtaagccagcatttgaatcatagggttgagaaactgccacaatatacccaaatagttcacttgatactttgatttcgtttcgtacactgcaagccgcataatcagcggaaatgagttgaattgctctttcagaatttttaccaatgcattcattctaatcttccttagtcgtaagttttaggtaatagctttgacttacaaaagcaccgctcataattgtaacagattacgatgtatttttcacttcataacaagcctgagtcccatgagcgcaacatgccgtcacttaagcaaaaaagcataattaacatggttaaattatgcttttttgcacttatttacttgtccccgaaaatcacttttacggctttttcagacgattctccggtttctaaataacagaacttctcgtaaaaaggcccgaacgaatccggaagcttataatcatctgattccgtttcattgacccatttgataacgtcacctgtttctttgacaagcgggccgggcgcttctttttcaaagtcaaagtaaaaccctctgagtttatcccggtacgtttcgatatcaggcacataaaacagcatcggtcttttcagattcgcatagtcaaaaaagacagaggaatagtccgttatgagtaaatcagagaccatatacagctcacggatatcttcgtagctggagaaatcatacgcaaatccttcatacggtccgagatcaaagttttccgccacgagataatgcatccgtaaaataatgacataacggtcgccgatcgcttctctcaattggtgaaggtctaaatcaaggtcaaacttgtattttcccttcttataaaattggtcatcccgccatgtcggtgcgtagataatcacttttttatcttgcggaagattcattttttctttcagcgctttaatgacagaagggctgttatccgtctgaaggaagtcattccgcggatatcccgattcaatcatggttttattaaactgaaacgcccgggcgaatatttcggttgaatatgcgttcggtgaaatcaggtaatcccactttgaagcctctgtcgtaaagttgcgcttgtatttttcagtgtttgttccgggcatatgcacttcatccatatctacggcaaggcgctttaaaggcgtgccgtgccatgtctggacatatgtcgtatgctcaggtttcggaatccacagcggcatacggctgttgacaacccagtactcggctcttgccatggcaaacagccatttgaacgtgaagcgttcgatataaggaatccctttatctttaaatgtctgtgagtaagcggggtttacactccagcagagacggtattccggcatctctttgctcatgtattcataaatcgcccgcgggttgcagctgtactgttttccggcaaagctttcaaacatgacaagtttctgtttgacaggcagttttcctgcaaatctgaatcctgctttgtaagtgttctgtattcttttctcaatgaactttttcagcttattctttctcttgcgtacaaaggaagcgccccgtttcagcttacctttcacaaaatactccacgcgggtgctgaagctgtaatcgttcattctcaggtggagatttttcgttttctttttcgtgaaaacgtgaaatctggcaggccctttttccgttttcagaaccgtgaattggttagggtttacatgttcagatttcagaacctttaacggtttgctgttggtgataacctcttcacctgtcccggcatcttcaaaaatgaattgaatatggaattgaaagatgagctgctgattcaattctttataaacagcattcaaatcaatttttgtatcaaagcctatcgtgtcaagcatcgttgtgtcctgaacatattcatcaaggtcgtgtctcggcacgtcgtgaagcggatacttcagaatgagaggctcctcttcttttccttttttcattttcagaatcaggtttttttcttttatctttaaggtttctgccgcattcagccggaatgcaaaacctttcagatgtaagctgccgtcagattcgagctccatttcatcaatccgcgtgacgaactttttctgcagcagctttaaggagaaattccctttcttcgtcgtgtaagggaaaaagtacatatgatgagcctcatctttataagaagacagttcaataggttcaaggctggattttaaccgttttttactgatatcactgtcatcattgataaaggagacatagaaatccagacatcctttgccgtccgtatggtcagaaagcagatccgtgctcatgacagcatggtactctccgccctctccggccaaccgtttcagagggacggaaagttccgcttttgttttacgatttataatctgaagagaaggctcttcccctgcagtgacattttcacaggatatcgtaatgctgaatgtctcttcctttatgttaagatgttttaacttgtatctgacaggattttctatacccataaaataagtctactcctctgtttcaattaaacatatccaatcacaatcatcattttgttactttcagtgaaaggttctccttcaccgtccggtagaattgatattgcagtccgttcgcttctgccgtcaccttttcaccgtcttctctgtttaacatgacacgttcataatcgttataaatgacatacataatataaccgccaagtccgactttttcaatgtcacttaacgggatttcaaggacgtaccgcccgtctcccagtgactgaaccggaaactggtggtgtactttcatgttatctctgtgctgaaactgaatatattgggcattatttctgtcctgtccgaacaagcggaacgtaacggtgaatttatgatcggcgaacaccgcgctttccgtttctccgtgcatgcgaagttcgaccagtttattttcttcatccgtcagcgggctttctaaataagccagtccgtctttcgtcacgatgtttttatcgggctcttttttggaccagcggaacagcttttcgacctcatcataccgtttttgagtcagcagacggtaggctgttttatgaatcggatgaaaaaatgtctcggaaatatcgtatttcgtcttctttaacacattcagaatttcattgaatttattgtagtaggcttctttgttttcgcttttcaggaagtgcatccgatcgaaaagccgcgtaatggaatcgaattcaatcaggcggttcatcgccatcttctctttttcagtatctaattttttgttcagaatatacttcattacggctatgttcgtgtcggttttttccattatattggtctgctttgtcagcgactcattattgtccattctgttcagataatagaccggttcggttgacgttgaaatatctccgcacgccaaaagaacatccataaaaaattgcttatcttcagcaaatttcatttccggatatctgatatcgttatcttttagaaattgtaagttcatcattcttgcccgcgggcccagatgatagaaaatatgccggattgaaaaaggcgataccttcgctctgttcagcgaagactcatgtttcccgatcgttttttgaccgttcacctgcatttcgatcgtttttccgaccgcataatttacatgatctctttcaagcatgtcgaataagattttaaccccgttcggcgcaaaccaatcatccgcatccaaaaatgtaatgtacttcgcatttgccagctcaattcccaagtttctcggataagccggagttcccgtgttgtctttcaaaaagacaactgtaatattttcatacaattcggcgtactcagtcaggatgtttctggaatcatcggtagagcaatcatctaccagaattaaagaaatatgctgaaagccgatgttttgaaggatcacagaatcaactgttttccttacatattcttctgcattataaacaggaacgactaccgctaccttcttctcttccgccaatgcttctttgtttaaaatggtatattcgcgttcttctatggacggcttggactcttttttattcaacttaaaaaagttactaagattcatctttaaattctcctcttattgtctagctttttttcaaaagcgcataacaaatatagcgaaaataaccttatattacaagaagtactccctatccggagggagtacttctttatcatctgtatatccgaatgtttcaattacaccccggcaatttcttttttaatctgtgtggtggaaatgccttcggttctagggagatagatgacttcgcattgatctttaaggaaatcgaatttgccttcccaatcgtctcccattacgaacacgtcgatgttgtgatccgctacgtcacgtactttttgatcccagctgttttccggaatgacttcgtcgacataacggatcgtttccagaatcagctttctgtgttcatagctgtggtaggcctttttttgtttttgcaggttgaactcgtctgttgagatggcaacaactaggtaatctccaagctgctttgcgcgctcaagcagtttaatatgaccccaatgcagtaaatcaaacgttccgtaagtaatgaccttcttcatgaaacaaaagctcctttctatcatcatacgtataacaagcaactgccctgaaatgctgcgcagctgtatccttaatcactaaagtgccaatttcgtactcatggaacctcattatatcacatagccctgaaaaggttaagctaatgtaaaacgaagttaaattccacttattaacaaatgttattgcaataggagtttagcagggtttttgcgcggttgattaaagaaattgttatcttatttatatttttgtaaaactattgttaagtttatctgaaggtattatgttaaaataaagcttagcttaagtcacgaaaaaatgaaagaaaatcccgtacaaaaaggaggacggcagatgcagactgaaatggtgcacaacctttcttatgttaatggaaatttacaggagtttatttcatatttagacacttattatatcgcacaaaagcaaggagccgtcattgcgacggtcaaccctgagatcggatacgctgcggcgaaagacaaaggttatcatcaagtcatttcttccgcggatttcgtcctgccggatggtatcggcgtcgtgttaatgtcacgtttgacgcagcacccgctgaaatcaagaattgcgggattcgatgtatttctgtcgctgctcggtctcgcaaaccggcagtctaaaaaaatatttttatacggagctaagcaagacgtgcttgacgccgttttgaaccggatcggcaaagagtatccgaatattgaggttgtcggagccagcaacggttatgaagcggataaacgcttcgtcgccaaacagatttcccgggcgaaacccgatctcgtgtttgtcgccttaggatatccccatcaggaacaatttatttatgaatacaaacatcttttccctcaggctgtatcgatcggtttgggcggaagctttgatgtgttcagcggaacggtgaaacgcgcccctgaatggatgatcaaaacgaatctggaatggctgtacagactggtgacgaatccgtggagatggaaaaggatgctgaacattccgaagtatgcttttaccgttttgagaaataataaatcaaataaaagcctgtattccgagcaggcagaagatcaaacgaaacagctttaaacaaataaaacagcaaaagagattggtaatctatgaacttgcgatctttattcgccgctttttattctatatatctgtctgttctgggcgttttgttcaagcctgtaaagcccaagaaccatctgaccctgctggtatcttttgaagagaatgcacaggctctcatccgttcttacaaagcgcacgctgaatcgctttcttatgaagtgacggttttgtatacgagacacgccgtcagtctgaaaaaagagctggaaggactcggctctttttatctgaacgaaaaacatccgctgcatcttttgaaggcggttttgatcctttttaagagcaaagcggtgataacggataactatttcctcatgacaagcgtcttaaaccgccggccgcaaacgacatgtattcaagtgtggcatgcgaacggctctttgaaaaagttcggccttgaggatgtgacgaatcaaaaccgtccggcatcagacatcagccgttttaaaaaagtgtaccgctcgtttgactttgtcaccgtcggttcagacgcgatggctgacgtttttaaaaagtcgttcggcatacgggacggccagctgttaaaaacgggtgtccccctgactgacgtctattatgaagaacacaagcccgaaccgaagcacaaatggccgaaaaaaatcatcctgtacgcaccgacattcagggattatgatatgcagtcctttcggctgccattcaccgaagaacagctcacaaacgcgttaaacggagagtatatgctgcttgtaaagcttcatcctgccgttttgcatcatatttcggcttcgtttgaaagcgaattgatcaagaacgtgtctgacatgcgtcttcatgatctcttgaaagcggctgatattttaattacggattactcttccgtgccttttgaattcgcgctcttaaataaaccgattttctttttcacgtatgatctggaggaatatgatcgaaaacgcggtttaatcgacaattatacttccgtcattcccggaaaggcttgtcatgacagtgaagctcttttggaggaaatgacgaaaaagccatttgatgcagaagaaatgaagcggttctcggacaaatggaatatgtattcagatgggaattcgagtgaagcgttattgaaatttgcggaaacaaaaatgaaaaattgtgctgaagcacctgcctgaatctgaggcgggtgttttttgcatgaagaaagggctgaagcatacacttcagccctttttttatactttcatatacacgggaacatcatagtaaagcgtatagtcatccagcagtgagtataagctgtacatgcggtttacctgcttatacgcccagccgatgtctgtcgcatactgatgagccgcggctggagaccatctcattttatacagcgtatcctgctcgtatgaaggattgtgaatataagacgcaccgataaattgggctccgccgataatcgcggcttccggagtaaaccagccttgcttatacgcgtattgtgcgccgtagtaattcgggttgctgtcataagccccgatgccgtacatgttgtaaacctttttaccattatacataatgccgttcgcaagctctgacgtgccattgcccgtttcaagcaaagcatgcgaaatcaaatacacttcattaatgctgtatttgccggcggctgtaataaaggcctggcctttccctgtcagtattcctttattgaccagcactttttgattcagttccgatgcgttcagtccggctgtctgagagagcttcagaaattgaaagtaatacttgctgtcttgtgcgaagtgagccggattgacgtactgcccgacttcgtcactgctggcgtttctccagcccatgctgagtttggcccagccgtttgtctggcctgtgatgctgactttatcgccttttttcaactgcccgataatattgcctgagctgacttccggggttgaccggacgttcaggacgtcggctgtgaccgttccggaggccgtattgatgtacgtaagcgatgcataagccgcggcatcagtctgcgggctgactgtcatttgttttttgaccatatctgccagcgagatgttgtaattggtgttcatgatttgcggtccgttttttattttcagaatagccatcgtccatccgtacagctttttcagcttttgggaggcggcgtccgctgactgcgctcccgtgaattgattgcgaatgcggagttcataaaccggatggctttcactcgtatagccggcctgtaattgtttggcgctgaaaaagctcatgcttttatttaaaacggttttactgctgaatttttcggttttgatgacgtattgtgcagagccggttttccccgtctccttcacagtgccggccgctttgttttgcttgaaaaaagcagtcacgcggtcaatgtcttccttcttaagcagcggtgccgtttcaattctgaattgtgtatacgccgcttcacctgttttctgtgcggaggcggatacttttttccctttgaaaaaatccagcgattgattgatctttgccgtatcaagcagtgattcggttgtgacttggtacgttgtgtccgtctgcttggatatcgtttttgaaatggcagtcagtttatatcccgccagcagattcaatcctttttttatcttcgactggtctgccgtctgctgagaaagcagctgatattcgttttctgctgtttttcccgccgctgttcttgccgtctttacatgctgctggcggaaaaacgcctccgtttgatccgcctttgcagcggtaagctgccctgccgtgatccggtaaacggacactgatgctgtctttttgacaggcgatgcgtcgcaatgccattttttctttttaaagaaagcttgcacgctttgcagctgtttagccgtcagtccgctcatcgcgaccgtgtaattattcttcttgccggctttttgatagcttccgctgacacccgtattcttcttgatttgggtgatagcattttgtacggcgcttactccgttaaaatatcctgactgcacgttatacacggttgctgttttgctttgggcatacttttgaacgttccctttgacgcctgttttctgctgcagctgtttcgctaaacctgccgcattatttgcatttaaaatgtcagaggctgtcacggtgatattcggactggcctttgccgtgactttcagcgacgactgcaatcctgtttccttttgaaaatcagtttgaatttgagcggctttttgatcgccggagattgttcccgattggatctgaaaccgggctgtttcccgtttgatctgacggtatgacgctttcacgcccgtctgcttcgtcaacgcttgcgagagcgcttttgcatccgcatcggccgccatctcagaagtcacgacctgcttatacggctgttttgtccccgccggcttgacggcgccggtcacgcccgtttttttcgtcagttcggcaagaagatttttcgtctgccgctcgtctgatagaacgcctgatgtgacggtcacgtacggctgtttgcttccgcttgcgctgtaagtgccggccacgcccgtctgcttcgtaaaatctttcagcacggttttcgcatccgtttcatcgtgtaagcctgaagctgagatttgataagtgagcggcgcatttccggctttctttgcgtcagcctgccaccccgtatcctttttcaatttcgctgccgcttgaagcgcctcgttctcagaagcaaattgctgcttcgtttccagctcgtaaacggagtagtcgctgtatgcggcctcggcgtgctgtgtaacggtgctaaagacaaggaaaacggcggacaataacataggtgcaacgaatctctttttcattccttctcctctttctgattcaattggtttctatcaaactagtttatttatcggcccgctttcttcatttttacagagagaaatcatccaattatccaaataaaaaaaacttaatcccagagctgggattaagtttggttttatatatgagaaacgatgatcgtgcaatctccgtttatcgtaaagtcaggcatctgatccggcagtatgaaatgcgcgcctttttcaagcttggcggacttgccttcaaagatgatggagccgcttccttctgtgacgctgcataacataaacggagcgtcctgggtcatttccgccgtcccgctgatatcccatttgtatacagaaaaatattctccctgcacaaaggttttaatggtgatgccttttctcgtttcagttgattcatccaaaaatccgtccacatgaggaacggtggcggcgttgacggcatcgcggatatgcagctcacgcgcaccgccgttttgatctgtacgcccgtaatcatatatccggtaggcggcgtctgaattctgctgtatttccagcacgagcgctccggcgcaaatggcatggatggttccgctcggcacataataaaaatcgccgggtttgatcttcacgcggcgcagcaggccttcccagtcaccgctgttaatcatggtgacaagttccgctttcgaacgggccgtatgaccatatatgatttccgcattttctttacagtcaataatgtaccagcactcagatttccccgtttcgccctgtccatgctcctcggcgtcataatcgtcaggatggactttaacggacagatgatgtttggcgtccagtattttagtcagcagcggaaaccggtccccttccgttccgccgaataactctctatgctgatcccacaggtccatcaaggttttcccttgatacggaccgcttttgaccgtgctcattccgtgcggatgggctgatatcgcccagcattcgccggttgtttctgaaggtatgtcatatccgaatcgttcgcgtaataacgtgccgccccatattttttctttacatacaggctgtagaaaaatcggctcttgcgtcatgttcgttcccctccccttaaaaagcggctcatatcccattccccctgtgtcttttttaaaacacggagggagccgcggttaaaaacaatatgtataaaatggctgacctgctcattataccattcggatggggcggaatgctcagtcatttcctattccagaataaaatgccttgtttgtcgcaaattaaaataactgatggaaaggggggaacattatgacgatacatgcggagctcggcaaaaaccttgaagcgctgaaaaaacggatcggccaaagcgatgacatgatgttttattcgtttacgtacggaaacggcaaatgtgacgcctgccttatatatatagacggactgaccgacaatcaattgcttgcggaatatattatttcgcccgtgcaggcggccgccctgcatcaagaggaaccggctgaaataccgccgtcatccatctctttcggctatcgtcacacccggctttcttcacttaaggacgcggaggcagacattttttccggcaaatcggttttgctggcggagggatgggaggaagccctttcgtttgaaacggaaacatttaaaatgcgtgatattgaagaaccggcttcagaagtgcttgaacggggacctaggataggttttgtcgaaaagctccgaacgaatacggcgcttttgcgcgagcagtccggtgatcccaacctccagatcaaagagatcacactcggcgaacggacaaaaaagcggatcgccgttgcctacattcgggatattgcgcctgatgatgttgtaaaagaagtgatgaaaagactggattcgatcaccattgatgacattccggaatcaggaacgatcgagcagcttattgaagataacacgtattccattttcccgaccgtcttgacgaccgaacggcccgaccgggttatgggcgctcttttggaaggaagggtctccattcttgtagacggaacgccttttacccttttggtgccggctaccattgatgaatttatccactcacctgacgattataatcagcggtgggttccggttaactttctcaggctgcttcggtatacatgcattttaatcacgatttatttacccggcctttacatatcgctcgttacgtttcacacggggcttttgccgacgagaatggcggtgacgattgccggaagcagattgaatgttccgtttcccccttttgttgaagcgtttattatgatttttacgattgagatgatcagagaagccggactcaggctgccgaagccgatcggacagacgatcggcctgatcgggggcgtggtgatcgggcaggccgccgttcaggcgaacatcgtcagcgcgatgatggtcattatcgtatccgttacggcattggcttcttttacggcgccctcctatgcgttcaattttccgctgagactcatccgtattttttcgatgattttgtcggcgatattaggtttatacggactgatcatgtgttatctgcttgtcgtcggccatctgatgcgcctgaaaagcttcggccaggactatcttattccgatcatggcgcagccgggacaggacttaaaagatacgatcgtcagactgccgacgcctcttttgaaaaaacggccgaccagaaaagagacgaaagataaaatcaagcaaaggtgatcaccatgaaaaaaccggaagacaagctgtcgtttatgcagacacttctcatggtaagcggaacaatgatcggagcgggcgtgttaacactgccgcgctccgccgcagcagcggacagtccgagcggatggatcattattcttgtgcagagtctcgtgtttatcggcatcgtcctgctctttatgccatttttgcagaaaaacagcggggaaaccatttatgagctgaatcaaagcattatgggacgcgccatcggttctcttcttaatttattcatcagctgttattttgtcgtcaccgtctgttttcaagcccgttttctcggtgaggtcatcaattactttttactgaaaaatacgccgatgggtgtcgtcatattcatctttctggcggtcggcatctaccatgtgaccggcggggtgtatcccatttcaaaactctatgcttatctctttccgattgcgatcgtcattctgattacgctgctcatattcagcctgagactgtttaaactggatttcatccgcccggtcatggaaggaggctacaaaagcttttttgagctgtttccgcgtacccttctgtatttttcaggacttgaggtgattctttatctggtgccgtttatgaaaaatccgaagcaggcgaaaaaggctgccgtcttcggcatcgcatgcgcaggcttattttacagctttacgctgcttgtcgtaatcggctgtatgtcgatcgctgaagccaaaacggtgacatatccgaccatttccctgattcacgccttggaaatccgcggtattttcatcgaaaggtttgatatctttcttttaattacgtggacatgccagcagttcacctgtatgctcggttcttttaaaggagcgcatctcgggttaaacaccattttcagactgaaaaataaaaacaatgcctggctgctggggggcttattggcagtgacattcggcctttcaatgtaccctgatgatatcaacagtgtgtttgcattcgcgaatattctcggatatgcgttttttgccgtcattatgattccttttctcatctggtttgtcagctggatgaaaaaaatagccgggaggaaacagacgtcatgacacatttcgtaaaatgggcggcggcgcttttcatactgatgacgctttcagggtgctgggatgcgaaggaagtcgaaaagctatctttcgcccgggggctggcgatagacgagacgagtgaccgccgatataaattaacctatcaaaacctgctgccccaaagtgaaaacagccaggcttccggccggcccgtgtttgtcaatgtgacgtcgcggggggataccattcttgaagccgtcagtgaagtcgctttaaaagatccgcccgtttacagcgatcatttaaaagtgctgatattcagcgacaaattgctggccgaccaaaatatactgcagatgatgaaccattttatccgtgatgatgaattaaggcggagcagctatctcttcgcggcaagaggcaaagcggccgatattctgacagagccgacgccgaatcagcagcagcccatgcccgcggaaaagctgatcgaccttacgaacaacggcggctacaacgggaagattttaaaaccgctccgaatcgggagagcttcgatttactgccataataaactcagttttctcattcaggccgtcagcaatcaaaaaggaaaaacggtgtatgacggagcggccattatcaaaaacggaaaacaaaacagattggcaggctttctgtcatcatacgaagtacaaagcctgaattggctgacggggacgatacagggcggcgtgctgcccgctttggataaaggagggcacccaattaccttcgagatcaaaaaatcaacatcctccatcacccccctgctgaaaaacgggaagctgtcgtttcacgtagcggtgaaaacaaaaggacttttgtcagaggatcaatatgccggagaagattcattcgatcagcactatttaaacgggctggaaaaggttttcgaaaaaaaactgaaaagcgatatgaaagaagtcatcgataagctgcagaatcaatatgaaacggaccctgtcttcttttctgacagagtccgcattcaatatcccgactattggaagaaagtgaagcatcactgggatgaaaccttctccgaagcggcctttgactatgatgtttccattcagattaccaacttcggaacgatggggcggtagccttcagcgtgttttttcgacacgaaggagaatctgataaatccggctttgttcgggcagctgtgtcaccggaaattgcatcgattgcgccattcgtgtgatttcctgtaaaaacagctgcacccgctcatccacgtgaacatacgtataggactgctttttcacgtcaaatgtctcttccggaaagagcgtgcgcaccgtctgcggcgtaaaaaaccgcaagtgggtgcggtcgagaatcccggcgtctctgtatgtccagtccccgagcagaagcgggaacagcgcttcggcgtgggaaatattcggaatgctgcaaacgattgatccggcaggcgacaaataggatgagtacgtttcaatgacgcgccacgggtcttttaagtgctcaaggatgtccgcgaaaatgatgcaatcaaaaaagccttccggataaggcagcttcactttttcgacatcttcctgcagcaccgcttcataatgtccttttgccgcttgcgccgccagcgggtgcagttctattccgtacagttcgcaaggctgtctgttttgaagttccagccccgtagctcccgcaccgcagccgacatcaagtatccgtttcgcctcccggggaacgagctccgcaatttccggtctcggatgagtaaagtacgtaaaatcagtgccccatttttccgtaaaacgctggcggttctccgaatataactgattgatattgatatcctgattagccgtaaacgtcgcatgcccgtggtgatgcacaaaggcatcgagagcgatgtgcaggctgtatcctttttgcagggcgcgcagacataggtcatcatcttcaaaagaaccgtatccgaattgctcatcaaacgggccgatgtcttcaatgacgctttttttcaccagaagacagaagccgacaaggcgcagcacccgctttgtttgatgcttttcccgtgcacaatacgcctccgcgaatgactccagctcatcaagcgattgatacgcgtcatggatcatttgcgcgccgctgacatagttgctgacgggcccgaccataccggttttttcagattgatacagcaccctcagcatggaggtgagccaatttttcgtgaccatcgtatcgttgttcagaaacagcagattttctccccctgccgcttcgattccctggttgcaccccttggcgaacccgaggtttttttcattaaggatgactttgacgtcaggcagatttgatatgtattctctcgttccgtctgaggaaccgttgtcaactataatcagttcaatcttatctttgtcggtgtatcgttcaatgctggccagacattttttcgtcagctcaagttcattatatgtaaggataataatactcgttttcaccggcatccccgcctttatcgtgactttatacaacgtatgacatatccccgtcatttatgtgaccgtgcgggcgcccgcacgcatccgttttgaggggccggtgaataaccgcccccctaaaactgaatattacggatgaactgtccgccgatttgattctgatcccgagcctccgttacggcttttcagatcctgctcaatttcttcaaggcttttccccttcgtctcggtcactttaaaccggacgaacaggaatgccattattccgatagcggcataaatgagaaataaatagctgatgccgactgcttccattagcatcggataggttaatgagacaatcaatgttccggcatgcagcatcaaagtggagacacccgtcccgataccccggacatgcagcgggaataattcaggaagcatgacccacacggcaggcccccagctgaccgcaaacacaatgataaacaggcctaaacaaatcaccgttgtccatgatgcggctgctgaatgttcaaagaaaagattgaccgcggccaatacgagcagactgatgaccattcccgcatttccggccagcagcagcggcttccggccgatcttatcaatgactttaatagccgcaagcgtcatgatgacattgacggcgccgattccgaccgttcccaatatagacgcggaattgccgaacccgacactggtaaatgttttcggtgcgtaataaataattgtatttgtcccgatgaattgctgcaaaaaggcaagtccgaggccggcaatcagcgcgggtctcacccacggctcaaacaattctttcaagccgccttcgttttccttttccgcttctttcatctgatcaatctcatcatcaatattcttcgttccccgcaatgatgaaaggatttctcttgctttctcttctttgccgatcgtaaacagccagcgcgggctttccggcataaataagattccgatcagcagaatgactgacggcacaaccgcaagtccaagcatccagcgccaagcgcctgcatcggcaaatatatagttcacgatataagaaacgaggattccgaccgtaatcatcagctgattcagcgaagaaagcgccccccgtttatgcttcggagccagctccgataaatagagcgggacgatcgttgtcgatgttccgacagccagtccgagaataatccggaaaagaaccatcacctctgtattcggggcaaaagcgactcctaatccgcctatacaaaacagcagcgccgctcccatgatggccttccgcctgccgaaccggtcggtcagtttgccggcgaatcccgatccgagaatcgcccccgccaataacgaactgacgacgaggccttctgtaaaggcgttcagtcccagttcttttttcataaataaaatagctccggaaatgactccggtatcatatccgtataacgcgcccccgagagcgccgaaaaaatagagccatttattcgagtgtatgcttttcatgttatatagactcccttcatccaacgctgtatccgcgcggaattgttctactgcttcttttgcctgtttccgatcgtttcaaaccttccgcaccgttaatatccattattttactgattatttttcacaaagcgacgaaacatttcccgcttcctgccgtccaatataatgtgaacctgatgcaaaaataacagtagatgttgtcgaaatagagagaaagatttagaattttctcatttgcagagttgctccgagtcaacaattatggtacgcttcacaaagaatagaaacgagaggtaatgatatggaagaacgatctcaacgcagaaaaaagaaaagacgcctcagaaaatgggtgaaatttgtactggtattcgccgctttcttattggtgatcgccggttccgtcggcacctacgcatttgtgaaattgaataatgcgaccaaagaagcgcacgtcagccttgaccgcggcgaccagtccgtaaaacggatcaaagaatttgacccgaagaaggattctttcaccgtattgcttttaggaatagacgcccgtgacaataagggtgaatcagtagatgacgcaagaagtgacgccaacgtgctcgtcaccttcaaccggaaaaagaaaacagcgacgatgctcagcattccgcgggattcctatgtcaacatcccgggacacggctatgacaaattcgcgcacgcacatgcttacggcggttataatttaacttataaaacagtagaaaacatgtttgatattccggtagattatgtggttgaaagcaacttcgacgcgttccgcgatgtcgtcaatgagttgaacggcgttacggtaaatgtgaaaagccagaaaattgccgatcgtattaaagtcgatacaaaaggaaaagtcgtgctgaagccgggcgtccagacgcttgacggtgagcaggcactggcttatgtaagaacacgcaaagcggacaccgatctgatgcgcggacaaagacagatggaagtgctgagcgccattattaaaaaatctaaatcgttaagctcgatcccatcttatgacgatatcgtcgacagcttagggaaaaacttaaaaatgaacttatctcttaatgacgccatcggtctgttcccgtttatcacatcgctgaaatcggtgaattctttgcagctgacaggttcagacagctacatttacactcctcagtacggcaaaaatatttattacttcaagctgaatgaggaaaaccttcaagaagtaaaaacgaaattaaaaaatgatttagacgcgtaagatgtcacggcgggattagcaaatcccgccgtttttctgttgaaaaaaaggacatgaaggtatagccttttaactgacggctttctgctgatttcgcacaaagctgaacatactacatgaagcagctttatttttaaggagggcatccatacatatgaaattgatagccattgacttagacggcacattactgaattcggacagtgtgatttctccggaaaacagagcggctttacaaagagcggatgaagcgggcattctcgtggccatctgcacgggcagagccacgtttgatgtaaaagcgctcttgaaggatttggatattccgatcattgcggcaaacggcgggacagtccatgacaaaggataccgcctcgtcagccggctcttaatggatcagcaggccgggaaggatatcgccgcttatttaacggacaaagacatttactttgaggtctatacagatgatcatctgctgtccccgtttgacggcgagtccaaactgcaggcagaactggacattctgaaaagcgccaatcctaaggaagatattcagacattatgggagggcgcaaagacgcagttcaaacaattcggcattaaacccgtacaggatatacaggcgatttttaacggagacgaacatgtttacaagcttctttgtttctcttttgatatggaaaaactgagaaacgccaaagaagaaattacacatcatcggaaattatcccagacatcttccggaaaacacattatcgaaatcctccctgccggttccggaaagggacgtgctctgacggagcttgcctcactgtacggaattgaaaaacaggatatttacgccatcggcgacagcccgaatgatttctccatgtttgaagcggcgggaaaccgcatcgctatgggcaatgcgattgatgaactgaaagaaaaaagcacctatattacaaaaagcaacgatgaaaacggcgtcgcatatttcatcaaccggcttctcgacaatgggcaataaaaggtaaaagtcaggtctttcacggcctggctttttcatgttttctaaaaaaggagtttcatgatgtcgaatgcaatcgctattataggatttttagcttttctctgcgcagtcggatacggaatttttcatctcatatgcaaagcggcaaaaaaagaaaaacatttttcaaaaaagctgttttggcctcttctcatcggcggatttatcctgcttctgaccggtgcatccctcgcagagccggacgcctcggccgtgaaggcagaggagaaatacagcacccttgatacggcttatcaaaaattgacgaaggaacaccaggcgcttgagaaaaaatatgaaagcatcagtgccgcagccgaaaaggagaaatccgaagctgaagccggcaatgaagaaaaactcagcaaactcagccaagagataagcgagctgaaaaaaacaaacaaatcactcaaacaagacaatgagaaattaaaaaattcacaaaagaagctcgaaaagaccgctgaaacgcttcagtcagaaaataaaactttaaagcggcagaaagcagaaacaaaaacatccgaaaacgcggaaacggcgcaaaacaacgccccttcctccggaggacatgccgaaacgaaagcagccggcacctcacagggatgcgacattaaaggcagccggtacggcatttatcacacgccgggaagtacgtactacgaccggacgacagatcccgcggaaatgttctgttctgtagaggatgcgatagcggccggatacagagcgccgaaacggtaaaagaaaaagacgtcagagacactctctgacgtctttttttacggaagccggatgccgcccgcatatttgtccttccaataagcgcttgtgttcatatttgttatggtaacacctgcggacacggtgacatgaatcacttgtccgttcccgatataaatggccggattcaggctttccgctttaaagaagaccagatcgccgggcttcagatcttgtttatcgaccggaacgcccgcctgcatctgcttgtcggcataacgcggcaggctgattcctttcgctttttgatagatgtattgaacaaatcccgccgtatcaaagccggtttccggtgaagcgccgcctttcagataagaaattccgatatgatcggccgctgtggacacaacgggattgtctttagaaatggctaaattgctgaatcggcgcacccctgtgaaatgttttttccaataatcttccgccaagtaagaaatggtgactttttcggagcggcttgcttggatgaaccttccctctcccgcataaatgcccgcatgggaaattccttttttatacgtatcgctgaaataaatcacgtccccgggctttatgtcgctcagtttgattttctcaccgaccagccactgctgttccgcagatctcggcaggtaaatgtgaagcttgttttcaaaaacatattggaccagccccgaacagtcgaatcccgcctcaggcgtgcttccgccgaatacatacggaatgtcgaggtaacgggctgcctcctgaacgatcggatcatcagccagttccggatcttttgtcatccgctttgcgccaagatataaattcatccaataactgcttttttgaaagcgtgtgacggttacgccttctgacggagaactgtgtatcatctctccgtttccgatatacagaccgtcatggacggccgcgttttgtgttgaatctgactttttgaaaaacacaagatctcccggtaaaaggtcattttctttgacggcggctccgactttccattgatcactgaccgttctcggcagatggatgttctgcctgctgaaaagataatgcatcaatccggacgggtcaaaaccgtcctcaggctcttcgcctccgtaaacatatttatttccgacaagtttttgcgcgtctgaaacgatcaggacagaaacttgagaatccgcttcggcaatttccgttctcgttactgcaggtgccacaagacaaatcataaggccggcaaggatgtacttcctccagcttgtgagcatgttttctattcactctcctcatttttagtagtttttacatcggtaacttttaacaaatgtttaggagagcacacaaaaaaagaatgcccgatatgggcattctttactggattcggaacaaacaatatgccggcaagcggaatcatgcgcttattttgcgcccgctgtgtcctcttgctgaattttttgcatttccgtgtcaattttttgtttttcctgatctgtgagctgatcattgtatttaaacgcagacataaacataaataccataatgatcgcggcaaacggccatcccgctttaatgattttcatttgtttttcactccgctttcttttttaagatatcgctgtgatccacatcaaacgttaattttccatccttgacgctccacttgaaattcgattctttcgtcagttcacgtacgatcgttttatgattgatgctgccttttttaaccggtgcaggcgttgcttcatgaatgttcatcggcgtgacttcaaagcgtcccgtgccgtttttctggagatgatattgaacaagcgccgtgtctctcgttcttgtccacccctggtcgaatacgaagttgcccaggctgtagaaaataacggtgccgtggtacatttcgatcggttccagcacgtgcggatggtgtcccacgataatatccgctccggcatcggacattgctcttgccaattggcgctgtctgtcattcggatcattatcgtattcctgtccccagtgtgtttgaacaatgacaagatcggctttctttttggctttagaaatcatcggaataaacagctctggatcggccggaagcacacccggcgcatttcgtttagctgcaaaaccttttccggaaacatcagtgaaacccagtgttgcgattttgattccgtttacatcttgataagaaatgttctgctcggcttccttcagcgtgaggcctgctccgacaagttcaagattttgctttgaaaactcttcaaccgtatcccgcattccttgagggccgtaatccatcgcatggttgttggctgccgtgagaactgtgaaattcatgtccttcaatacttttacggcatctttgtttgactgaaggtggatatttttttctgcttctttgtagttctttttatatgtaaccgggttttcaaagttccctgacacatagtcggatgattcgaagaatggctttgcataacggaagacactctccgtgcctttatgctttgtcactttctcgacattccggcccatcataatatctccgacaaatgaggctgatacaaggtcatcggcatttcttttcacactcggcgtttccgccttccctgtcaggatgcagacgaacatcaggcaaaagacgattggcagcgcgataaaaacgtgaagattggtcttctttttctgctgtttggtcagcttcagcagtttttcttgaaagcttaattgttttttcatcgtttgacacaccttacattagattaagtagtaagcaaacataatggcaaaagttgcgccgcttaagaacagcgtgctggcgaaagtaatcgttaatccctgtttctgaatggtattggcgatcagacccggtacgatgataccgattccgcggaattctgatatctcaaacggtacgatcgggtaaagaaaatcaagggcgatttttaagcagattcccgttatcagcatagctgcgaattttctgcgtccgtacaatatcataaatctggataaaccgtatttgacgatcacgtatgtaagaagactcaccagcagtacgagtaaaataaagaccggctggttaaaaacgagccctaaataacccggcacaactaaaccggcaggtacgatacctgttttttccgcgaaaattaaactgattaacacgcctaaaataagtgaaatgtataaatctgatccgaacatttatccttttcctcctagctaacgagctgtttcaccttatactcttggattttttcaattaatggttccgctgaaccgtggatattgccgacgccatatatgacacggttttgcattcttgttttcagcacgtccatgatttcgtctgttgatttatattccagatcgtgcagtgtatcggcaggaatcttgccttcttcataagctctgacgatcggttctgtcgtctcgccgatgagtatgagttccttcgttttaatgtacggaagcacgtcgtttgcgaactgaatcgttctgtccacacggtcggcgcggcagttcatgatgacgatcggttcatctgtcgggtagccgatttcctttacacgtttccatatatttaaagtagaagatgcatcatttgcggcaaagccgtttacgaaatgaccgggctccttcgtgctgagcagcggcaggattctcatggcgccaggatcaggcggcgcgttcagcattcctttaaacgccgtttcttcatctatcccaagagcctgggcaacgccgagcgccagggaagcgttatcaggaaagaccatatattcaaattttcgaaggtattcatctgtaattttagagttatccgcaataatgacctcggtattccgctctgcggctttttctttaaagaagtctgtgtattcactgtctgtaatgacaaggtgaccgttatacggtatcgtcgcggtaaaagcttcagcaatctcatcaagcgtcggccccatgacatccatatggtcttcaagcacattcacgatgacgccgatgttggcttgaaggagttcttcctgaaagataatctgataatccgggtttactgccatacattcactgacaatggcattggcgccccgttctacggtttccttcattacttctttttgctcgccgatattcgggccctgcggtttccgtttgatcggtttctcctcaggtgtatcccaatagatcatccttgcatctgttcccgtcgtttttccgactgttttgtagcccgcctccatcagtattccggtcgtcagcctcgttacggttgactttccgcggataccattaatattgacgcgtactggcagagcatcgatattcttctgatgccgccttttttcaatgattccgatgattagtacggcagcacaggctataatgagtaaccacattgatttttgacatctccttctgtattgataaattcattcatcagtatatagcttcactatgaattctcaatcggcattatgtaacataatcttcccgctttcactgagccaaacttctctattagtgacgctattcttcctattatcgaattgctttttttgggaataggcaggacttaaaccttacttcaattttttaaaagaaaaatgtatgcgtttacatttccgcacataaattcatttggaccaatgggactatacgcgttccggaagaaaaagatgtaatgataatccatcttttacagcctgttatatcagcgttttccgcactgcgcatacgtttcgggactctatgtccgctgtgtgcagactgcctgttttgttaaggataaggtcttaaagtcattcatttttcccccgtatcctgctttcagtcccattccaaaataactagcggaatgactggtacgtgacagaaaaagacgggtccggagtgtttacaagaaatacacattttatatgcggaaagcctatctccttttaaagcatttacaggacatttatcactcttttgaaataattttaataaatctttatattcgttcaagaaatattcatccataattgtgaagttcttggtaaaacgtcgagaaactcctctattttataaaatgcataaaaaaggaatacccgctgaaaactacaaataaccgggaaaggaggcggtctgatgtctgcggataaacaaaacaagcggatttccggcgattttgaatcggctgtacgggaaatgcaggagctgatgtgtgtttgcggtgattttaaaatacgaaggatcaaactgcaggaccgtcataccgctttcttttatattgaacaaatgatagaagaacagaagctgaatgagtttctgttaagcgacaccctgcagaacggtccgcttgaggaaacgatgaatgccgtcagcagtgcggaaacggatgaaaccagaaaactcattgacgggattttggcaggccaggttgtttttctcagcgatgcatcaaggaaagcgaagctgttttccgtcgggcagaatccgctgcgttccattatggaacccgaatctgaaagtatcgtccgcggcgcccatgacgggtttgtggaaagtttggaaacgaacattcatcagctgcggtttcacatacaggaccgccatctctccgttcattatatggatatcggggaaagagccaaatcaaaggttgcggttatctttgttgagaatatcgccaatccggagattgtggaggaagtgaagcggcgcctgtcatacctgcgtatagacagcgtgcttgcgcccggaattatcgaggagtcgatagaagataattcgttttccatttttccgcagatcgttcatacggaacggccggataaagcaaaagcatgcgtgatggaaggctgtgtgctgatcatgatggatggcagcccgtcggccttgattgcgccgatcacgttcttttccttttttcaatcgccggatgactacagcacgaggtggatttccgccagttttttgagagtgctgagatttttcgcctttatgatcgcgattacactgcccgctttttatatcgcgctgattgcgtttcattttgaagtcattcccaacgatttgattatcaccatgaaaaattcgattgttgatattcccttccctccgctgatagaggccatgattatggagattacgattgagctgatccgcgaagccggtatcaggctgccgaaaccgatcagtcagacgatcggcattgtcggcggtctcgtgatcggtgacgcagtcgttcaggcgggactcatttctaatatgatgattatcgtcgtggccgttacggccgtttcttcttttgtgcttccttcatatgaaatgagcacgtccattcgaacgctcagatttccgcttatgtttctggcatcctcgttcggttttatcggcatcgcattcggcttcggacttattctgatgaacctgtgcaagcttgaatccctcggcgttccgtatttatcatctctgacgccgtttcatttcagtgacttaaaggatgcatttatccggctgccggcctggtttattaaaagaaggcctttttatttgagaccgcaagattcaaagcagataaaacatgttcgggggtggagaaaagatgaagcctaaaaaaatcagccggcttcaaggcgtgtttttcattaatcagacgcagatcagcatcggcattttggcgctgccccatttactgatgatgaaatcgggaagcagcggatggatttccattctgcttaccggattgctcgtccagcttaccttcagcctgtatatgatattatttcaccggtttccgaagctgaacctgtatgaaatgctggaggaggtgttcggaacacttgccggcaaaggggtgcaggtgctgtatattttatatttcgcgtttctctgcacgctcattctttctgtatttacacggttattggatatctgggtgctccctcagactccgaattgggtgatcagcttaatgctgatcctcggttctgtctatatcgcccaagccccgctgaatgcgatcgcgaggttcagctttattttaacgccgtttttgctgctgatctctctgccgcttttatacacactgggaaaagccgatatcacatacattatgccgatttttcacggaaccgcaaaagacatgcttaccggggtgcagcaaacacttgtcagcattaccggctttcaggcggcgcttgtgatcgggccccttatcaactgcaccgtcagccagcgctacaaaatactgacgatttcaaacggcttgattatcctttattacctgtatatcactcttacttgctttgtcaccatcagccccgaagaaataaaaatgatcccggagcctgtgctgtacctgttaaaaaccgtttcattcagaattatcgaacggacggatctgctctttttgacgttttggttcgtgaccgtcttttcaacgctggccaacgtgttttacttggcaagcaccggcatcgccaagctgttcaatcaaaaagatcacagccggtttgtttatccgctggccctgctcgtcttccttctgtctatttgggccacaagcacagataaaacgatacagcagctggatcagtttttccgcatttccgatattgtgtttgtgtatttgtttccgttgtttatggtattgattgtccttgtacgcaaaaagggtgtccgccatgcgcattaaaaaagcggttcttatcagtctcatgtgcgcaagcctgacacttgccggctgctgggatcaaaatttgttgaaagatatttctctcgtgctgaccgcaagccttgatgttgatcatgacggtaaaaataaaatcggcattacctatcggaaggttcagtcctcccaggcggaacaggaaacgggcggctcattcattacgacggtgctcagcgcttccggacacaccatccgtgaagcgcggtttcaattggataagcttgtcgaccagcgcattgacacgtccaagcaaagagtcttattaatcggtgagaaaatggcggaaaaaccgctttttccttatctcgatgtcttttacagagatccgaaaagtccgcttctcgctcatccggcggttgtaaaagacggcgaggcgattgaagtgctgaagctgatcgtccggcagaaattgatcgtcagcaagtatttaacgaatttattaacaagcgctaatgcggaatcaaatatcagcatggaaaatttgcaatccatccgttcaagcatgctgacggctgataaggatttcgcccttccttatttatcgattaacggacagacgataaaggtagagggttctgccctgttcagcggacagcggaaagtgactgaggtgctcggtcaggattcgaccctcctgacccttttaagcgggcaatttaataaatcggctaatattaatctgaagctgtgggacaaatacaaaatggatattgaaaattatctttctctcggcatcacggatgccacgcgaaagattgtatttatagatacagatccgcagcatataaaagtgaaaatccgtttaaagctgaatgcacgcgtcttggaatatccgaaggacaaactgaattcttatacggcaatcgaccaaatgaacaaacaagcatcagcaaatttgaacagccaggccagatcggtgatcagccatattcaggagcacaactcggatatcctcggcatcggccggaaatatcaaacccattattatgagcggggcaagcggctcaattggcgtgaggtctatccttccatcgagataatccctgatatcaaagtgaatatctcgcaaatcggcatcgtgaactaaaagagaccccggtctctttttttgttgccaaccgaaatgattcgtggtactctttttgtgtaaacggttacataaatgaagggggagtgtttgttggtaacgattaaagatgtcgcaggcgctgccggcgtctctgttgccacggtctcgcgtgtcctcaatgacaacggctacgtccatgaagatacacgaacgaaggtcatgcttgccatggagaagctgaattattatccgaatgaagttgcccgctctctttataaaagagaatccagactggtcgggcttttgcttccggatattacgaacccctttttcccgcagcttgcccgcggcgctgaagacgagctgcagcgggaaggataccggctgatcatcggcaacagcgatgaagaattggaaaaagaactcgactacctgcaaacatttaaacaaaatcaagttgccggtattttggcggccacccattaccccgaccttcccgaatacagcggcagcctttacccggtcgtatttctggaccggacaaaagaaggcgccccatccgtattcagtgacgggcgggcaggcggaaaacgggcggctgaggaaatgcttcgcggcaaaagcacaagcatcacgcttgtcaaaggcccaggccaccttccgaccgctcaggaacgttttaacggcgcacttgatgtgctgtataaagcgggcgcgcagttcaatgtcatctccgccgcttcattttctatcaaggatgccgccgttttagcagaaaaattgtttgcagcataccccgaaaccgacggagtcattgccagcaacgatattgcggcggctgccgtcctccatgaggcgctgcggctcggcaaaaaagttccggaggagattcagatcatcggatacgacgatattccgcagagcaggcttttgtttccgccgctttcaaccatccgccagcctgcatatgagatgggaaaacaagcggcaaacctgctgctgcaattgataaagaaagagccgccgaaagagacggccattcaactgcccgtgacttatataagaagacaaacgacgagaaaggatgatcaccatgagtgaaatttgtgttatcggaagctgttctatggatctggtcgtcacatccgaacggcgtccgaaagccggagaaaccgtactgggcacagactttcaaaccgtgcccgggggaaaaggcgcaaaccaggccgtagccgcttcccgtctgggcgcaaacgtatatatggtaggaaaagctggcagtgacagctacggaaaagcgattattgaaaacctgaaggcaaacggtgtcaatacggactatatggaaacggttacacataaaaaaagcggaacggctcatattgtgctcgcagaaggagacaacagcatcgtcgtcgtaaaaggcgcaaacgatgacatctcacccgattatgccaaaagtgcgctggaaaaacttcccggcattgatatcgtgctgatccagcaggagattcctgaagaaactgttgaagaagtgtgcagctactgccgcgcgcaccaaattccggttatcctgaatcccgcgccggcccgcccgctgaaacaatcgacgattgagaatgccgcatatcttacgccgaacgaacatgaagcatccattttatttcctgaccggacgaaagaagaagcgctcgccggctatcccggcaaactgttcattaccgaaggaaaacaaggcgtacgctactcagacggcaccgcggaacggcttgttcccggcttccctgcagaagcggtcgacacgacgggtgccggcgatacctttaatgcggcacttgccgtcgcgctcgcggaaggacgggacatcgagcaagcgctcctgttcgccaaccgcgccgcctccctgtccgtgcagcacttcggcgcccaaggcgggatgccggtcagaaaagaagttgaggagctgctgtcatgaaaaaacacggaatgttaaacagccacattgccaaagtattagccgatctcgggcatacagacctcatcgcgatcgccgatgcgggtctccccgtccctgacggcgtccctaaaattgatttgtccttaacggcgggcattcccgcctttcgggatgtgaccagcctggtagccggggagatggccgtcgaaaaggtgatggccgcctccgagatcaaagacgaaaatcctgagaatgcaagtttcatagaaagccatttctcagcgcagacgatcgagtacatgtcccactcggaattcaaacggctcacacagaaagcaaaagccgtcatccggacgggtgaaatgacaccatacgccaactgcatcctgcaggcgggtgtgattttctagaaagaagggatccagcatgcacatcggcatgacagacattcataaagcattcggcaaaaaccaagtgctatccggcgtctcatttgagcttctgccgggagaaatccacgctttaatgggagaaaacggagcgggcaaatcgacgttaatgaatctgctcaccgggctctaccggctcgacaagggaaacattacgataaacggaacaaatatgaatttctccaatccaaaggaagccgaaaagcacggaatcgcctttatccatcaggaactgaatatatggccggacatgacggtgcttgaaaatctttttatcggcaaagagctgacgacggcgttcggcgttttggaaacgaagaaaatgaaagcgctagcaaaatcacagcttgaaaaactgggagtctctcttcctcttgaccgggaagccggacaatgttccgtcggccagcagcaaatgattgagattgccaaagcgctgatgacaaacgccgaagtcattattatggacgaaccgaccgcggcgctgaccgaacgggaaatcagcaaactgtttgacgtgatgacggcgttaaagcgggacggcgtatccattgtctatatttctcaccgaatggaagagatattttcaatttgcgaccggatcaccattatgcgggacggcctcactgtcgatacggcgcatatgaaagatactcattttgatgaagtggtcaaaaaaatggtcgggcgggagctgaccgatcggtatccgacccgcacgccgtcactcggcgataaggtgctcgaagtgaaaaacgcctcaaaaaaaggaagattttcacagatcagtttccatgtgagcgccggagaaatcctcggcgtttccggcttaatgggtgccggacggacagaaatcatgagggcgctgttcggaattgaccggctcgattccggagaggtctggatttccggccgaaaaaccggcattcggggtccgtacgatgccatccgcaagggactcggcctgattacggagaaccgcaaagatgaagggctgctgctggatacgtccattcgtgaaaatatctcattgccgaacctgaccagcttctctccgaaaggcatcattgaccgaaaacgcgaggcggagttcgttgagctgctcatcaagcgtctgaccattaagactgcatctccggaaaccgccgcccggcatttatcaggaggaaatcagcaaaaagtcgtcatcgccaaatggatcggaatcggcccgaaagtcctcatccttgatgaaccgacaagaggcgtcgacgtaggcgcgaaaagggaaatctattcattaatgaatgaactgaccgatcgcggagtcgccatcatcatggtgtcttccgagctgccggaaattctcggcatgagtgacagaatcatcgtcgtccacgaagggcgcatcagcggagaaatcaatgcggcagatgcaacacaagaacacatcatgacacttgccacgggagggcagcagtatgaaaactgaaccaataacatcaactgaacaaaagcgattttccattcataccttcacgcaaaaactcggtccgtttctcggcttactgattcttgtgctgatcgtttccgttttaaacccgagttttcttgaacctctcaatattctcaatcttcttcggcaggttgcgattaacgctctgattgcattcggaatgacgtttgtcattttaacgggaggcattgatctctctgtcggagccatcctcgccttatcgagcgcagtggtcgcaggtatgatggtctcaggcatcgacccgatcttagccgtcatcatcggctgcgtgatcggcgccgtactcggcatgataaacggattattaatcacaaaaggaaaaatggcgccgttcatcgccactttggcgacaatgaccgtctttcgcggactgaccctcgtctatacggacggaaatccgattacggggctcggttcaaattacgcatttcaattattcgggcgcggttattttctcggcatccccgtacctgccattacgatgctgattgcatttgcggccctgtgggttcttctgcacaaaacaccgttcggccgccggacatacgccatcggcggcaatgagaaagcggcgctgatatcgggaatcaaagtgccccgcatcaagatcatgatctattctctgacaggtttattatcggcgctggcgggagcgattctgacatcacgcttaaattccgcacagccgacggccggagaatcatacgagctggacgccatcgcagcggtcgttctcggcggaacgagcctgtccggcggtcgagggcgcatcatcggtacgctgatcggggttttgattatcggtacgctgaacaacggcttgaaccttctcggcgtatcatcgttttatcagctcgtcgtcaaaggaatcgtcattttaatcgcggtgctgctggaccgcaaaaaatcggcatagtaggaggaccattatgaagaaagccatcatcacgatcgcggcattatcactgtttttgctgtccgcctgttcacttgaaccgccgcaatgggcaaaaccgtcaaacacaaaacataaaaaagaattcactatcgggctctccgtctccacattaaacaatccgttcttcgtttcattaaaagaaggcgttgtaaaggaagccaaaaaacggggcatgaaggtcattattgtcgatgcccaaaatgattcatctaaacagtcaaatgacgtagaagatttgatccagcagggagtcgatgcgctgctgatcaatccgaccgattcatcagcgatttcaacagcagtcgaatcggcaaattccctcggcattcccgtcattgcgctggatcgttcagccgaacacggcaaagtcgaaacgcttgtcgcctctgacaatgtcaaaggaggagaaatggcggctgactacctcgccgatcagctcggaaaaggcgccaaagtggctgaattgcaaggggtgccgggcgcatccgcgacacgggaacgcggaacgggctttcatcatattgccgacaaaaagctggatgtcgtaacaaagcaagcggcagattttgaccgcacaaaaggattgaccgtcatggaaaacctgctgcagggacacccggatatcaaagccgtgttcgcccataatgatgaaatggcactcggggcgctcgaagcgattaacagctcgggcaaacacattttggtcgtcggtttcgacggaaataaagatgcgatttcttccattaaaagcgggaagctgacagccacggtcgcccagcagccggagctgatcggaaaactggcggccgaagcggcggagcaggtgctcaaaggaaaaaaagtcaaaaaaaccatttccgctccattgaaacttcaaacgcaaaaataaccggctgatgtttagacttccggtaaaacgtgaaaggatgaagtaaaaggagagatacagatgaagaaaacagccaaagcggcatccattctgacccttgcagcgggaatatcagcggcttcagctgccggaataacgcctcttcccgagacacacgcgcaagaagcggtcaaaattgacgatctgtacagctacccgcttgactcttatctcgtttccgcggaagcattgaacgtgagaacaaaagcatcagcagccagtccgagagctgatacccttcatttaggcgacagcttaaagatcgtttcattccagaacgctgactgggcaaaagtacattataaaaacggaaaaacaggatttgtatctactcattatattgttaaagaagcaacaaccgtaaaaacgacggcaaaaacaaaagtatatacagacaaacaagcggtcacagcttcccttgccaaaaacacgagcgtttctttcctcggatggaaaaagacagccggcggcggcattgatttcggctgggcgcttgtcgattacgggggcgcaacgggatatatcagcacaaaagatctgcaaaaactgacataatatcaaaacggatttcgcaaattcagcgcgaaatccgttttttctttcttgagcagtcagaaacgtctaaggttcgaaatatttctcaggaaatattgtcggatgaagatgaatgcatacgactctaaaatggcttctttatgtaatccgccaggcgtttggcgttgtcacggatagccgcagcatcggcgctgctaaccccgtacatcgcgaaagccggcaaataggtcattcccgtaaaattagccattgcctgaaacggccttaagagctcgctcagtgaaaaatggttggacccgcctgcctgatatgcatcctctccggcacctacagaaacagccagcagcaattctttgccgtgcagcgcctttcctttggaaccgtaagcccagccatacgccagcacatgatccatccatgtttttaaaagcggaggcgcactgtaccagtacagcgggaattgaaatacgatccggtcatactgttcacacagctgccgttccttttccccatctattttcccgtccggatattctttataaagctcacgaaccgtgatgtcatcatgattttttaattcttctgtccacgccttattgaccgctgagttgtccatgtcaggatgaaccgctaataccaatactttcacagctaccacacctttcccttttgactgtattttacctaatctttgccggttcagccaaataaaaagaaagccccgagaaaaatgaggctttcttttttattttattccgggcttccttcggttgtttcaatatccttcgcaaaattcggattatctaaatttgcgttgaaaaagtccgccgtattcggaagcttgaggttcatattcattttttgagaaatggtcactttacaatctttaatgacatagtcaaacacgtgtcccccggaattgcgtccttcatcaatgaagtgcaggtgatatccggaaacagcgatgccgtttgcgtaacccggcgtccagaagccggcgattgtaccctgaatgtcgtcaaagttgaacacaggctgtgttttcaccgcttcaatcatcggaacgtacggtttctcctggcgttctaccgttcttgtctgcacctttttaaatacgccgtctaaacggatcgcataaaataagtttttactaggcagaaggctggcgatttcctgctcgaattcttcacgggtcatttcgccgtcgatcgtatgcgtcatgtccggcgtgaaaaatgtgaatgagcagaatggtgacaggtctccgcctttaacaggcgtagccgttccgtcgccgcgcagacggtaaaattcgccgtcaaatccgattaattcgccgtccagtttattgaacgtgccgatcccgaaatcaccgaacttcggaatgtcagccatatcaaaatctccgtcatacactccgtccagcagagatgtcatggtggatacttgatagatttgatcctcaggtgagcctttttctccgcggctcatcatatggatgtcgcttgcgtttttcatattcccttcactccttttaaattgggctgttttagaaaacaggtcatggtgcgcagagtgctagagagcttttgctttcattttttctttgaattgcttcggaagcatgtcgcttgataaatggacattgtcactgtaatcgacaggaatgtcaatgatgacagggccttctgtgttcaagcctttttgcagcacgtctgccagctgttccggtgactcaacgcgcaagccggtggcgccgaagctttctgcatattttacgatgtcaatgtttccgaaatctacgcatgatgtacggttatattttttcatttgctggaatgcgaccatatcatatgtgctgtcattccatacaaggtgaacgatcggcgcttttaagcggactgccgtttccaattccattgcagagaacaggaatcctccgtctcctgaaacggatacgactttttcacccggattcaccaatgtggcggcaatcgcccaaggaagcgctacgcccaatgtctgcatgccgttgctgatcaacagtttcagcggctcataagcgcggaagtagcgggacatccagatcgcgtgagaaccgatatcgcaagtgacggttacgtcgtcatcaattgcattgcgcagttcttggacgatttgcagaggatgcactctgtcggatttatgatcgcttggcgccttctcgctgtctgtgagcatctgttttaactcgctcagcacttctttttcacggctgcccatatcaaatgtcacagcgtcgtgttcaatttgtttaaccgtagcggggatatcgcctaataattctaattccggctgataggcatgatcgatatcggcctggatttcgtcaagatggataatagcacggtcaccgtttacgttccagaacttcggatcgtattcaatcggatcataaccgatcgttaatacgacatccgcctgttcaagcagaagatcgcccggctggttgcggaacagtccgatccggccgaaatattggtcttccagctctctggacaatgtgccggccccttggtacgtttctacgaaaggcagttttgttttggcaagcagtttgcggatttgttttaccgcttccggtcttccgcctttcataccgactaacagaacgggaagtttcgccgtctggattttcgcgatagccgcgctgaccgcctcttccggtgcagggccttgtttcggcgccggcacgctgcgtacgtttttcacatttgtgatttcattcacaacatcctgcggaaagctcacaaaagccgcgcctgcctgacctgctgacgctgccctgaaggcgtttgttaccgcttctggtatattccctgtttcctgtacttctacactgtattttgtaatcggctgaaatagcgccgcattgtccaatgattggtgtgtccgttttaaccggtctgcgcgaattacgttacccgccagcgccactaccggatcaccttctgtattagccgttaacaagccggtcgccaagttggatgcccccgggcctgaagtaacgagacaaacgcctggttttccagtcagtcttccgacagccgcagccataaatgcagcgttctgttcgtgacggcataaaaccagttcaggtcctttatcttttaacgcatcaaatactgcatcaatttttgcacccggaatgccaaaaacatgtgtgacaccttgctccactaagcaatcaacaacaagctccgccccccgatttttttcagaggtttttagttcatttgttgcttttgccaacaccctcactccttattatgcatattaaatataaaattttaagtaatttgtgatattattcactatacactctttggaaattgacctccaatatcaattcgccgtatgattaatatgtttcacgaataattaacaaagagaaaggaatggataaggatggagcttcgccatcttcaatactttattgccgttgccgaagaacttcatttcggcaaagctgcgcttcggttaaatatgacacagccgcctctcagccagcagatcaaacagcttgagaaggaagtcggcgtgaccttattaaagcgcacgaaacgggttgtagagctttcagctgccggagaaagttttttaaaacacagcagaaacgcgatcgaagaaatagacaaagcgattgaaatggcgcagagaacggcgcggggagagctcggccgccttgtcgtcggttttgtcggctcggccacatatgaatttctgccgccgatcattcgggaattccgcgaaaaattcccctccgtcaagcttgatctgcgtgaaatttcttctttcagacagcaggaagaacttctgaaggggaacattgatatcggcatccttcatccgcctttacaacattccgcgttacatatggaaaaggtgcagagcagcccgtgcattctggctttgccgaagcagcacccgcttaccgctaaacagacaatcgacattcaggatttaaaaaatgaaccgattatcacactgtcgaaagaaacatggccgactttatacctggagtttgtaaactactgcgagcaggcgggcttcaaaccgaaaatcgttcaggaagcgacggagtatcaaatggtgatcggattggttagtgccggtatcggtgtaaccttcgtgccttcttctgctaaaaagctgtttaatctcgaagtcgcctaccgcggcattaatcaggcgcagctcactgccgaatgggtcattgcctaccgcaaggataatcaaaatccgatcctgaaacattttctggatattatgaataagcgccaggctttattgcaggcggataaggaaaatgcataaaaaagagggccgccgaaagcagcctcttttttttgtgcttttatggatttttactaaattggtagaaacgctcagtacaccttacgacctgtacccgtatacatacagtacaactgatcaggagggataaaaataacggggcggcaatgacccatcgaaaaggaggcagaacacattacacatattaccgtcattttgaccctgatttctttctttgtgaccattatttttatattttggagacccgggggattaaatgaagccgttccggcgtcgctgggcgccattctcgttttgttatgcggaaccgtttcctttcatgatttgggggatatagggtcaaaagtcaccggagcatcaataaccattatctccacaatgataatggcgatcgcgctggaaagcttcggtttttttaactgggcggcggccaaactgcttcaccgcgccaagggatcaggcatccggcttttttggctgaccaacctgctctgtttttcaatgacgctctttctgaataatgacggcagcgtcttaatcaccactcctattttactattggtcttacaatatctcggacttaaaagacatcagaaaacaccgtatttaataagcggcgtattaattgcgacggcggcaagcaccccgatcggcgtcagtaatatcgtcaatttaatttctctcaaaatgataggcatggacctttatttgtacaccaatatgatgtttatccccggcacgctgggactggtgtttatggcctttctgctgtttgccgttttctaccgccgtttgccgaaacagctccccgatattccggttcattttgaatcgctggaacacaaacgatatcatccgcttcagcctccgccagacttgtcccaaaaaaacagccgtacgaacatcatgttttgtgttttggtatttgtattgtttgtccggatcagtctgtttgcagcttcttacaacggcatatccgtttcgctcgtggctgtcatcagttcagtcatcctgctttgctggagatggttttatttaaaaatcggaccggcggacttattaaggaaagcgccttggcatatctttatttttgccttcacgatgtacattatcatttacggactgcataatatcggactgacggcattgcttgttcagtctattgagccttatgtctcacaaagcattgcccacgctgcatctattatgggcattgctacatccgtcctctctaatttgttcaataaccatcccgccttaatgatcagcactttgacattaactgaaatgtccatcgacccattaaccgtaaaaatcatttatctggctaatattatcggcagtgatatcggatcattgcttctgccgatcgggacattagccacactgatctggatgcatatcatcagacagcacggcgaaaaagtttcttggtcagaatatatcaaaacgaccattgtcgttgtccctctcaccgtcgtgtttaccattaccgttttatatgtttggatcagctggatttacctttagctatgaaaaaaaactgcctgctgtataagagaggcagttttatcatttatggcaggtgcatggtttttaaatgattcaatttccaaaagacagtatccccgtctgcattggtcaattcaagaatattatctgagacgtcctgtaacagccccactttattcggtatatctcctaaatccagaataatcagcttcccgacatatctttttaattgctcctcaaaattccggacaaggggcacattagcgggaacaaccggcagctctgaactgtttaatgtatacggcgtctgctcatcggaatagggtgtcagccatttcaaatgatgcatcgagatgaaaagagtcttataaaccggagagaagaaaacaaaataatcatttaaaacacttgtcacatacccatgaatggaacggtctcccgtaacgaaaatttctgtaaatctgccttttatatgctggagggtattccggtaagaaaaggaatgttcctgtttttcgggatgcggacttttttttcttgcgtacggttctttattctcttcgtccgggagcgtcaatgtcatcctctgaagatgcagcagcggaatataaagaaacgtccggccgtcatgaatcacaatgatatcctgaccgatatccaaaagagttcctgaaaatgtcgtattccccgatatctcaatatcgacttgtttatcaagaaatctgcttaatccagccatttcattcccccctctcccgcgtttacggacaatctttccaatcatttacggccgtgtttccacctataatctattgtccttaatacagtggcgtagctataagagttctcttcctcccgttttgaggatcgaacggatcttgacgatcttttcgactttttagaggaagtacgctgctcttcgcgagattcttcttcatgtgacttttcttcttcggcgctctctttcccgcctttattctcgtcgtctttattctcctcttttttggctgctccttttgccccttcgctgatgctcttgatatgaaaaggatagatccgcagcacttctttatctttcacaagagtgtagtggccgtcggaattatccacaagtataccttcaacggcttcaggacctccgcggttgatggatacccatttgtggatcaggcgtttaaatatgccgtgaaaatcatcagccatttcaaattccgggcgctcctcctcctggccgtcctcttcttgttccgcgctgatgcttttgacatgatcggcgttaaaatatacgattccgtcatcttctgtttccagcacgagaaaatcatcccctgtttcgtgaagctttcctcttttcgattccggacctccctgattcaattgcaccgtgcgattggtcatccggctgatcagatcttgaaaatcatcagctttttcacattctgccgcttcggccggcgatacggtttcactcgtattttccgtcacacttttcacgtgtttccattgataataaacgattttattatcaacttgaagagcgatataatccgattgaatgtctgctaatctccctgtcttggactccgggcctccccggtagacagtaattacttttccttccatcgcatgcaaaaagttgtcatcagaccgatgccgcttcgtattgcgtttcatctattgtcctcctagtcatttttctcataatgtaaaaagcataatgcatatatacgtatcacgattattttcgggaactgattcaccagcctatttgtaaaaaatctttcttcatttccaaatcagatattccaccgctctaactcactgctgatgaaggcggaccgctccttaatgtattcgcaaatcacatcaggctcccggtcaaagcaatcaatctcctctttcttataaggatcctttgcgacatgcggcctgatctgctcatacagtgacatgaccttcggcttcatatgttcaatggtaaaccgggtctgaagcgtttcttccaaaagctgtttgtacgctttgcggaaatacggttcatccagaagccttgcagtcaaggtattaaacccttgtattctgacataatcggcctccatccgatcaccgtgaatgtctcttccccacgtcgcatcgtaatcccacggaatgacttcaaaaagtcccgtttcatgattccggtacaaagcgtaattatgaacaaatccatcgtagtttgaggtaaacacgatgcccgcaagccaccgcaaatacttatcggcgtccaagtgtttgacgatctcccccttgaactctgacttcggaacggtattaattttatagatcatgtcctgcaagtataaatcgtcttctttcgttcccgttttcttttcataaccaagttcgagcgatgttttcgtatcccgctccagatcactgacaagggagaaattggcgtcgtcatcaaccgcgtaaaaaacagccccgtccgccaaattccgtttcgccagaaaatattcatccactgactccagctcaagatacaccccctcatgtctgccattgatttgcagggttacgaaattcgcctttggtgacagcgtcccaagctccgcgaagaaatcgagagacagcttattccgcatcatcgacggatctttgtattcagcgtttaaatgtatctctttcgccctgcgaaatgttttcggcgaataaaaagcgatgtgatacgattttttcttaaaatctcttatatgagagccgcggtacgccagatcaatgtcaagccgtttttgattcactctcagcaccgcgggcaccggatcatcatcccaaatgtcttttttcagctccattaagtctttcgggtgaataaacagctggtatagaggcaatgttgattggtctttcatcagtaaccctccctgtattaatttaggctgtgctatttatataaaactcagcgaatcacacatacacttttttcattcatgcgtactatgtggtagtaaggatcgcatccttaaaacatatatcatgaggaggtttcaaaatgggccactattcccattctgatatcgaagaagcagtaaagtccgcaagcaccgagggattggaagattatttgtaccaagaaccaaaaagcagtaagaagagaaaatctcgcagccataaaaaatcccgttctcacaaaaaatctcgcagtcataaaaaatcgtgccgctctcacaaaaaatctcgcagccataaaaaatcgtgccgctctcacaaaaaatctcgcagccataaaaaatcccgttctcacaaaaaatctcgcagtcataaaaaatcccgttctcacaaaaaatctcgcagccataaaaaatcgcgccgctctcacaaaaaatctcgcagtcataaaaaatcccgttctcacaaaaaatctcgcagccacaaaaaatcatgccgccgcaagaaaaaacgcacgcagaaaaaaccttaccgtcctcataaaaaagacccttgcaaaaaagacgattactgcagcaaaacagagtactggaaagacgggaacatctgggttgtaaagaaaaactacaagtaacgccatttgtaaataggctgccggctaaacggaagcctttttcctcaatcagatatatgccacgtgataagatatgcagccggttttcttttgttgtgtttccgaattttctttctgtataatcaggtcatacgataaagaaaggcggccgaaatcatgcatatcttacgagcagacgaactgaacgcaaaagacacctacaaattgctttcgggcacagtcgttccccggccgatcgcatttgtcacgacgcggtcatccatcaacggcgccgtaaacgcggcgcccttcagtttctataacgttgtctccgcagaaccgccgcttctggccatctctgtcagccgcgcggacggacggcagaaagacaccgcgagaaacgcaatcgctcatcgggaattcgtggtgcacgtcagtgatgagtccattattgaagacattaacaaaacggcggcaaggcttgatcctgatgtcagtgaacttggcatgacagacctttctgtgacagacagcgcctgcatcagcgttcccggtataaaagaagcaaaagtcaggtttgaatgtatactcgaacgccatcttccgtttcaaaatgacagcggagaaacgacgacagacctcatcatcggcagagtcgtttgttttcatttgaatgaccaagtatatgacgccgataaaggctacatacggacagatgagctgaagcctgcggcaaggctcgcggggaatgaatacgtcagactcgggaagacatatacgcttgtccgcccgacctgaagcaggaaccattataatagaagaaactagtcaaaaagacccctttcgaaaggggtcttttttgagtcttttaccattaaactcagcctaatgtcttatagaatgctgaaacttacaaggccctcacccatatgaaacgagtgacatttttaggaggagacgatggatttcattcagttactgattttttcagccgtatttattttgctcagccttatgtttcaagtatttgccgtcaaagttcttcattttccaaaggctgttaaaaagcagaagccgataaacggcacacatcgattaatcgaaatcacactgcttattacgggcatcgcagcggtgactttgttcaatgaaatgtacgtatttgcgggagttgttttcatgctattttgctgcagcggcttaatggaatggcggcaccggcgggaggaaaagcaatatgtgtacgattcgttttacgcaggtctttctgccgctcttggcgtgcttatttttttcatcagttagcgtatcatgctctatactcctgcggccgctccgtcgccgcgcgggtcggccccgccttggagaaagccttcttcatcaatgacgatcgctgccgcatggcccataagcccgtcaaaatcaccaacggtctcgacgcggtggccgctctgccttaaggcttctctcgtttcagggctgattctgctttcaaccctcagcccttcatactcctctccccatgtccgcccccagacccagcgcggctcattgatcgcctgctgcgggtccattttgtaatcaatgatgcgcgtaatcatcgctgtctgagtttgcggctggccttctcctccctgggttccgtacaggatgtgcggctttccttctttacaggccatcgccggcatgagggtgtggaacgtccgcttgccgggttcaagtgtattgacatgggattcatccagcgaaaaaaatgacccgcggttttgcagcagaatgcccgtctcccccgccgtaacggctgacccgaattcaaaataaaggctctgtataaaggaaacggcatttccttccgcatctctgacggcggcataagcagtgtcgcttccgaccggacggcttagcgccggcgcagccgtgtcaccgatttcttccgccagctgctttgcataccgtttatcaagcagccgatccagcggaatatgagaaaatgccggatcagtcagcacttcattccggtgctgaaaactcttcttcagcgcctcgatcagcagatgataatagtcaaaggagccgtgttcaatctgagaaaaatcatagttttccaatatattgagcgtcattaagcctgtaaagccctgtgaattcggcggagcctgatagatgcggtatccgcggtaatcagaggataccgggttcgtccactcgccgcggtgggctttaaagtcatcaagtgtcagacggctgccgttgttttgcagaaaggatgtgatgctttgagcgagatctccttcataaaaagcgcttctgcctttctcggcaagctgttccaagctggccgccagattcttctggacaaaccgttcaccgggcatgggcgcttttttgtttctcgtaaaaatggccgaggtgtaaggcatcgaggctaaaagagcgagattgcgttctgtgtgggcgcactggtcggcggacaccgggaatccgtttgccgcataatcaagagcaggcttcagcacctcagcgagcgaaagacgcccgtacgccgaaagcacggcatcccagctgtccgccattcccggaacggtaatggcgctttctggcccgcgcagagggatcgcttctctgccccgatacaagtctctcgtcacatgcttccctgaacggccgctcccgttataagctttgattcgtcccgtttctttatggtaagtgagccaaaatgaatccccgccaagacccgtcatatgcggatacacgactgccaggcaggcgctgaccgccactgccgcgtcaaacgcgtttcctcccttttccagaatgccggcccccgcctgagaagcaagataatgcggactgacgaccatttgtttcgttccgatggttgaagtattcatggcaagcccctttacaaattttcctaagtataaaaagcggcttcaccggtatccaccttcctgaaagaaaagctcacacactatttactttccgataagaaataatcctaagttattacgtaacgaaaacaataaaaaaatttccccttcataccgtaacatttcatgatacaataatatccaccaaatgaaggaaggtgaagccggttggaacatgagtacagcattccgaatcttgtccttgatgaaacggataaacagattctctcgattttgcacgaggaagggaggatttcctatacagacttaggaaagcgggttaacctgtcgcgagtggcggttcagcaccgcattcagcatttactggatgccggtgtgattgaaaaattcaccgctgtcatcaacccggcgaaaatcggccgtcatgtgtccgtgttttttaacgtggaggtggagccgcagtatttggaggaaaccgcattaaagcttgaaaaggagccggcggtgacaagcctttatcatatgaccggaccgagcaagctgcatatgcacggcattttcgcaaatgatcaggagatggaagagtttttgacaaaacggctctatacgcaaaaaggcgtcgtcagcgtcgactgccaaatgctgattaaacggtataaaagcagaacgggcatgaagctgtaaggaggacatagccatgaaacatccctattgggacattacggcggcgatggtccgaacgggcattctcggattcggaggcggcccgtcggtgatcccgctcatccgccatgaagccgtcaataaatacaaatggatagatgatgatgaattcggagaaatattagcgatcgctaatgcgcttcccggaccgattgccacaaaaatggctgcgtatctgggcttcaagctgaaaggcacgttaggcgcaatcgcggcaaccctcgcacatattctgcctacatgtctcgctatggcgggcttgtttgcggctgtcaatgtcttaagccgctcagcaatcgttgccggcatgattggcgccgtaacaccggtgatcgccgtcatgctcggcatcatggcgtacgagtttggccaaaaagcgcttaaaggtttcggctgggtcacgggcatcctgttttttatcatcgcttttatcggcctgcaaacgttacagatcaatcccggctttgtcattatcattttcttggcatacggcgcgtttcattttaaattaaaggacaaaatcacaaagaaacgttcaaaagataaaggaatgccggcctcatgatcttgatttatgtatttatggcgtttcttgtcgcaaacgtactcggatatggaggcggaccggcgtcgattccgctgatgtttgaagaagtcgtcaacagatacagctggctctcaaacgatcaattctcaaatatgctcgcacttgcgaacgcattgccgggcccgatcgcaaccaaaatcgcggcgtatgtcggctacagcgcaggcggatggcccggattcctgattgcgctgatcgccaccgtcgtaccgtcggcgctcgcattgatcatcctcttgcgcgtcattcagcgcttccgccaatcccccgtcatcaaaggtatgacgctgtccgtccagcctgtcatcgccgtcatgatgctcattcttacctggcaaatcggcgcagacggcatcaaagcgatcggctgggttcaagcgatagtgattgcggggatttccctccttgtcttgacaaaattcaagatgcatccggcctttctgattatcgcggcgtttttgtatggagggcttgtgattcctcatttataaagaaaagcacctggacaggtgcttttttattttggcccggaaataccatttgatatgacaactgtttcttcgcctgcatcactcttgatgatttgcttgacttgcagcgttgcgcctgccattctcacagattgctgaacctgaggtgaattggtttcagcctgtatccaaacagaagtcggcgctttccaagctagaaagagtgcaagaatcaacataccagagataaccagcagcagcttcatatcgcatcacttcttttcaataaacggctcgcagcggacagcgcctgttgatcatgaagaatatcacccggacgattgccttctcccagcacatagcctttaaaggacatccccataaaatgaaaaatatgttcaaattgctgaatcagcggcagcccttttagtttagggttgtctccgcccactgctgttacatatgcctgcttcgctgacatttgctgtttaaaatcaggaaacctcggatctctcagcgtctgtgaccagcgatcaataaacagctttaatgtccctgacatgccaaaccaataaattggggtggcgaatacaagaatatcacacggtaatatcagctcaatgatagaatcgtagtcatcttgaacaggacgaaagccgccttgggcgtgacgcagatcttcaattggccggatccgatatttccgcaaatgaatgtgctccgcatcgaatccttgaacagccttctccgcaagaatatccgtatttccgccaggcctcgttccgccatgaataaccgcaatgttcatgatgcatctgctcctttgtttacgaatgattttcttcatcatataatggattcatcaatcaatacagatgattatttcgattattccaatcgataaaaccgatttagaaagggcgagatcaaatggaattgaagcagctgatcacctttattaccgcagcagaacacgtaaacttcaccctaaccgccaagatgcttaactatgcacaatcaagcgttacctctcagatcaaatcactggaagaagaaatcgggactcctttatttgaacggctcggcaagcggcttttcctgacagaagccggcaaaacgttcaaatcctatgcggagaagatcattgcgttaacagaagaagcaaaaatggccgcaaatcaagcaagagaaacaaccggaaccttgaaaatcggcgcgacggaaagccagtgcacataccgccttccgcctatcataaaagaattcaaacaggcttttcctcaagtaaagcttatattcaaaccgtatatttccaacgaacaagcgaaagaacagctcttgcagggccagcttgatatcactttcattttggatgtgaatcggtcggaagacgcactgcacgttgaatctctgattcaggatgaaatcaaaatggtagccgccaatgaccatccttttccagcagactcaccagcagcattgaaggatcttcaaaatgaaacccttctgctgacagaggacggctgttcatatcgcacgctctttgagaacactttacatgacgccggagtctaccctaataaattagaattcgtcagcatagaagccatcaaacaatgcgtgatggccggactcggaatcggactattgcctgaaatgacagtaaaagacgatattgccgaaggacggatgaaagaactcaactggcagaatgaatgccccgtttttactcaactagcatggcataaggacaagtggatgtctgcgccattaaaggcatttatcgatttgacgcgaaaaacattcaaataaaaacctgctgcaaggacgacaaggttttttaaagcagacaccaggcatacaaaaaaaacacttggtggcttagagctccaagtgtttcatgtgatttttccgataaaacgttcgcaaaacatgcgtttcaaggtcagccagacggacagggatcggcagcctgctttctcgattgatcattttcattgtgatctgatagctgctttctaaatcaatgttatgtccgcaagacaagaagataggcttcacgtcccgccgtgtccgaagcgcccagccatatacctcgccgtcaatgagaatatcggtgtaggcgcctacttcattttcaggcatctcaaaatcgcagcctttgattttgagataggttttcgcaatcccaatcgtcggcttccccagaaaaaaagccgcatgggtggcaacgcccatatgattgtaatgcagatacccgttgccatcaaacaaaaacacatccggctccgtctccagctttttggccgcttcgatgatcagcggcagctcgcgaaacgcaagaaaaccggacacatacggcacgctgattttccccatgctgtgcactttttcaatcacttctgttgtatcagcgtcaatcacgatgatactgcacaccccgtacggttccccgtcctgctcccaataagcgaggtcgacgcctgcgctggtgttgacggagtctggatggatgacgggggataggttgattttatgtataagagattgttgagttcgaataaaatccgattcatctttttgttcaaaatcgtgaatttgatgtattttcatttcacttgttttcctctcttaaaatagtcttcgcgctcaatcgtcctgtgtttcgatctagcgaagactccatatgcttcattgaaaaaagcagatagtataatctgctttttattaaaattcatttttcatttctttcataaaaataagatccaattgtttaagtaattctttaagttcagtacacataatatcttctaaaggattttcccaatctttgttttttatcagttcaatgccataactgccggttggatccccttctgggtaccaccctacaagcagcaaatttttagttttatgagaaactgcaggagatcttgattaaagtcaaataaccaagcatcatcattttcctctagagttttagggtcagtatcttttaatggaatataatcaacagtccaccccgctggtatcttaagccttaagaaattgggaacatgttggcttaggtgctgcaaaccctctaaaaccccacttcccacagtccagatttgatattccaactcttccaataattgttctatttcattaaaagagtcttctttataaatcttatctgtttttaagcccgctactatgacatggtattaatcattttcaaatattaccttaataacagcattacgtttttcattttgtagttttagtaattcatatttttcttgcattcttttttctgaacttaaattgttcagtactacagaccagccattacagatttttaatggcagcaattgagaaatatggtctctatccataactgcttctccttgtactccacattgttaaattattataaaaaaacttgccgataacaacaaggcaagctcttaactatagcaattctaatacatcagtaaacaaggcatctcctaatgttaatctcctgttgaaaggctgtatatgtggcaattcactccactcatacacagtatcgtagtaatcatacaaataactgagttcgataaaccctttctcttgcattattttattaatatagttcgttccctgaatgaattctaaagattcagcggttcctacaatgtcataagcgccatctattaaatcgtgtcttagggaataactataatctaatacataaacaggaaccaatttagatactttcatattgatttgctgttctaaatgaaaaccattttccccagaaagatcttgcaaatggatatcaatttctcctgaaggattgtttaaatctctaacttcaatttttttcaaaccttttatttgattaaattcatcaggtacttttattttctctgcgcatttgctcttgtaccattcgtctaattccctattcacaaatagacgatgaagcaattcaccgatttcagggtattcattaataaatctgattccatgttccatagttttaaccatcccatcttcttgaaggctcgccttttttcgtctgcttaccagttacaggatcaaactctcctaaatgctctgttcttctgcggttccacttttctaatttaccatgctgggaatcccattgccaattaaacccatctctatctgaccaagattttctttttaatctttcttttatttgtatcatacctctttcttccatccagttagttggttcttttaaacgatatccatttgaattgtctccaactatcttctctttatcagctagcgcagcattgtattcttcagtccgtttctttttactgtagttagtaccattatgagcaacataatcattttgagtcatcccctcaggtttttccaaccattttggtttttttgactggctactcgccatcttcacaatcccaagttctttaacagccgtcttttccacatcgacacggactgttgggaatccgtacgtaaagccgttcgctgttactgggcgttctgcgtacacgcggacgtttgtcgggactttgaattgtttaactttttctagtgtcttgttagctttttgaacttttgaatgggttgcaagcggtatgcctttgtttacatgcttcgccaatgcaccggctccaaccaaactcagcgcagcttccagcgccccttgcttccgtttttcctcagacactttgtttccgaacatatcccgtcctgtgacggcttctgtgaatccgtttgaggcgacgaggccgtatgcgcccatttctgtcattttgagaatgtctaaggattttccggttttataggcatctaaagcatgttctgcggcaatgacggtttttccggttttgtaaatggcttttccgcctttgaaagcgcggcccgcccagccgacgaccggtatgaatccggcggcggccatcgctcctgctgtgacgcgttctgcggtggagagtttttcgccggtcaccggatcaacaccttcggctgctcttttataatcataatagccggtgacttcgccggtaaagttgcagatgccgtcccatgttttttcgtaccatggtttattggcttcttcttcagccttttcctgaagccgtcttgcttcggcctgctgggcttttgcgtcaatatagtccgtgccctgtttttctgtcgccatgacgcttttgtagatttcattgctgtggaaggcttttttgtcatagtacataggggaggcgcttttcccgttgctggtggcctgcatgagaagggaatatttgctgagcactgcgttgtccagagattctaagttttgatattcagcggtcagggattcatcaagcgtatcgactgccgtgatcgtgtcgcgtctggttttctgggcatcacccattttatctgcgtaatcatccagcgtatatgtatcgagatgaataatatcactgatgccagacaaaatcgaatcgatttctgctttatgagcggagacaatctctgaagctctcaaatccgcattgggcagctcatgctctaaaaatgaagtctccgcatatgaatcactgagctcttgatctttaatgtcacctgaaatgccatttaaaaacgcaatttgagcagagacaagcgtcagccagctgtcggcgatttccgcttgtccctgaaagaaatcctttatattgtctgcgcctttccctttcaaagcatcacccagatcggccacgccttgaaaggcttgtttgagcgcacgcagctgttcttcaagggcttcgtattgtttctttctcttatctgcttcgtccgttaacgattgtgattcaaacactttgctcatcggcaagtcctttctttcgttattttacagcgatcgcctcgtcctgttccttcaaagaatctacgttgtctttaacgtccgctatgttcttatgaacggcctgcttgtattcgctgatcatcgatacaagctttgcctcgcgggattggtatttggaggtatagtcgagcttgttttttccgtttgtaccggcgttcccgatagaaacggcctccaaagcgctgctgacggattcaagctgcttcatgacggctccgtatttgagttttatttctgccattaaaaccaactccagctttttttgattgattgtattttttctccgaccgtgtcaagggcttcttctcccagcgtcagcaggtgctctgcctctctcgcgatgcttctggcggcaaggagccctcctttttcaatttcaagctgtgtcatctttaagccgattctgtaaatataaccgtcgtatttgtctgtgacgattctgtatgcttctgtatgggcctgatcgcgccggtcatcaaattcttcagcaaaagtgccggtccaatgatgatccaggtgcggcctgaggatgtccctgatttcagacacgccctcttcctgcagagattctatctctcttttcgcttcttttaatttatcaatttggtgttcgatctcgcccagtttatggctgatggtgctgttaatatggcttaatgtgcttgaatggctcatctgttttcacctcgtcttacgcaaaaagtcgtacaaaaagcacagacttttccatactatatttccatatattatattttaaaatagacagaaagcagcttaaataggttaaatgacttattttcagcagccgagatgctcatcattaacgccaaaagactcacacaaacggcatatccattcattgatctcctctatgtatccatgataaattccctaaaaaaaagagacagtgaataaccgtctcctttgccttgtatcatgattctaataatgtcgttaactgcagtcccagttgtacaaaacgtttgagaaatcttttttcttcaaatcttccggtctgataaagaaattggcgattcccacatctccccacatcgaatcaatgtcatcatctgaatcaatttgcaagagcagaatcgtatggttttgatgggaataagaccgcggatcttcctgggtgaaggacgcatagccgccgattttatggccgaatgcgttcaccgtatattcgtcatacacctcatcgtcaaactgctcgaaatagtcgaaggcatccatcccggcatattgcctgaattgaaaatcagacgggagcgcccattcagcagacagctcaggggtgatcagcgcttcggattgaatcggaaaatcgtactcctcttcaacctgaacgaaagaaaaatcatccatgagctcctcttcccgatctgtcacgtgctcaaaatatttgacgcagaaacccgtttgcgcgcacccgtcgtcaaaattcaaaccgtatacgtcatcactgaccgatatgtaaaactgaagaatgccggtgtccggaaaatcaggtagtccgggcatatccgcaaaattgatttgggcgagaagcttcatcggcctgccgctttcatcttcagggtatggttcatgtttcggaaaataggggtctccggcaattttattgtcatacagtcccgtttcagcttttttgacgtgcagtttgataaagggccgtgctgacgtttccagcagaccgcgggatgattccatttgcttcggcaatttccatgtgttttccacgattaatatctccttcgtctctaatgattgtatgataaaaggccggcgcggaccgccggcctttcaagtgacagaatcagtctgaggcacgacggctcttcttccgattgagatatattccacgcccgcctgttccgcttcctcaagcgagtggcagtttctcccgtcgaaaataaccggggtttccatcagctctttgtacgcttcaagcgggaagtgtttaatttgttcccaatctgtcagaatcaggacggcatccgctcccctgacggcttcttctatggactcccgataggaaaccgcagacggaagcagcccggaagcccggaatgacgcgatcggatcgtacgctgtcatccgggcgtcaagagccgccagacgatccgcaatgacaatggacggggcatcccgcatatcatctgtattcggcttaaaagacagccctaataacgcgatggttttccccgtcacaccgcccagcctgttcagcactttatcaaccagcatggactgctggttattgttgactttaatgacggacttcagcaattcaaaatcatgctccacatgtcccgcgatctgcacgagggcgtttgtatccttcggaaaacaggaaccgccgtaaccgatgccggctcttaagaattgattgccgatccgtttatccaatcccattccgtgtgcgactgattccacatccgcaccgactttttcacatatatgagaaatttcattaataaaactgatttttgccgctaaaaatgcgtttgacgcatatttgatcatctcagcgcttctgatgtccgtatgatataccggaatcgcaagcggcgcgaaaacccggtcaagcgtttcccgcgtctgccggtcttcagccccgatcacgatgcggtcgccgtgaaaggtatcgtgaatcgccgaaccttcacggagaaattccggattcgaagcgattgaaatgttcacgtccgctctcagccgtgaatgaataacttcgctgattctgtcattcgttcctacgggaaccgtgctttttgtcacgacgatcgcatctttagaaatatgttcggcaatctgttcggcgacattttcaatataagtaaggtttgcgtgcccgtcttctttttgcggcgttccgaccgctataaaaataacgtccgcttccgcaagccctttttcgtagctcgtttcaaatgccagccgatgccggccgatatttcgtttcatcatatcttcaaggcccggttcaaagataggggacaatccctttctcatctgctcaaccttacgttcgtcaatatctatgcatgttacgtcatggccgatttctgaaagagacactcctgtcacaagaccgacgtagcctgttccgatcactgttattttcatcgtgttcccccaaccgtttagaaattgctgctgggcagcttaccgctattatcatatgatcccggcaccggcggaatgccgggagcctgaggtcatgataggaaaaaacggcgccggccgctgataatagcataagcataaaagaatcatcttgcaaaacagccgcttacgcttcatttaaacgggatggagacgacgattaaaaaagaccccagcgcttacggcgggccacaggcagcggaggttccttataaacggctttgttttcagcgagaagcgccgcattttccgtgagcatgtaaatcagctccgcccctgcttcttttttcagaacgctgatcgcctcctgataataaaaatttctcggtccgagattatgggcgtcagatgcgagaaagtggatcaaattcgcttccatcagctgcagcgaaaaggatttcgctttccgcccgaatgctccggcaatgcagccggccgtcacttgggcggccgcccctttcttcacaagactgtaaaggacggaaggattttcgcgaatttccctgttccgctccggatgggcgatgacggggacatatccgttcagctgcagttcataaaacagcctttcagcataggccgggacatgatccgccggaaattccgccagcacatactttgtattatggagcggggcaagcgagccgctttgaagacctgccagcagatctccgtctattctgatctcctggcctggcagaacagtcagcggaatgccttccttattcaaacgtttgtttaacaggctgaccgcttcgttgaccgtatgccgatccgtgtcatagcggtatttcacatgatgcggcgtcgcgatgatcgtatcaatcccctgtctgaccgcttctctcgccatcttcaggctttctgtatcatccgccgcgccgtcgtctatggaaggaaggatgtgacaatggatatctatcatatttcaatccctccttaaaaagaatggaccgcgcccattgtgacattattgtccgtaataggcgtagtccgaatgtttcgtttgtttcttcccgttcataacggccccaaggagcttgcacgggcagtaatcgagcgcttctttcgccttggccgctttttctttgtccgttttcccgcttgagatcaccataatggccccgtcagtgtagctgcctaatattttcgtatcggctacggccaaaacgggaggcgtatccaaaatcaccttatcataaactgcggctgcttctgacagaagatctttcatcgcacccgtcgataaaagctccgccggattgggcgggctcggcccgctcgttaaaatatccaagtttgcttcatcagccggcaggacggcattctgaaacggcatctgttttaacagcagcgacgttaatccggttccgttatccaatttgaaggtgaaatgaaccgtcggtttgcgcagatccgcatcaattaaaagcacttttttcccctgctgtgcaaatacgacggcaaggttggccgcggttgtcgattttccttcttccggaccggcggatgtgatcaaaagggacttcacctccgtatcaacggaagaaaattcaatgtttgtgcgaatcgtgcgatattgttctgagttgatggatttcggctcagacatcgcaatcacgcttcgttttccgggtttgtcttttttacgcgtcaacatgtccgcctcccgcttgtttggtttccgccatcctcaagcttttggcaacgctgtctttagtactgattgaagtaaccgttcccaggatcgggatgccgagcagcgcttccagctgttcttccgatttgatcgtattatccagatgttccagcaaaaaggcgagaccgattccgcccaaaagtccggcggcaaacgcaatcgcgatgttcagcttacggttaggctctgccggtgactggctgtccgacacttcggcctttgaaaggatgctgacattatccacgttcatgatggcggtgatcttgtcctgaaaaacggatgcaaccgcatttgccataacggccgcccgcttagcatccgtatcccgaacggcaatcgtcacgacttgtgaatcctgctcgctggataccgtgattttcgattccagctctttcgaagtcatggacagatgcagctgtttaatcacctcatcgaggatgaccgggcttttgatgatgacattatacgtgttgattaattggaggttggtttgaacgtcattgaattggacttctttttgattgtttttggattggctgaccaaaatttgagttgagttttcatagaccggcgtaagagcgaagaaactgatgagaccgcctgcggaagatgccgccgcggtaataataagtataaacagcagacgctttctcagtattgcgaatatttcctttatgcttgcagattctcccatataacctccatatcactttccgtgtattcccattccctccaatgatcttttccaattacgattatacagctttaaactgtcatttctaaccttttcaaatgacaaaattcgacaaaaatagacaatcacttcaatctgtattatatttgtaagcgctttaaatactggtgtcacaggaagattaaaaaatcccgcggccaggaggctgcgggattttatgttgcatatccatttttaatataagaaatcaaattctcaagcatttcttttgtggtcatctcagaggactgctcaccgatgtcgtgcgcatgcattaaaatcttcagaaactcctcttgatctaacttcgttttcttcatcattcgtttcctttcggcttccattaaattgaaaacaagattattatatgctgtcgggtgctgttttgcaatctctaatacatcattcgacacattcgggtttttatgtccttttttaggaaaaactttttccgggccatgtgttgcgatataatagaggaattggaatctttttattttgtgactcgttaggagcgataatcatgcttcaggatatgattgctaaagaagatgtgctcgcagcggctgaacagcttaaagaacttcttccttacaatgaagacaatgttcagctgatgaagaaagcactcattttatatcggcaggattccgtctatcgtatacaggttcaaaccccgacagagatttccgcatatgtgcaggatgttgtgcctgtaagggtcacgctgaacttatttttcatggtgaaaagcggctgcgcatgcccgtctgaggcgatctgccgccacgtgctcgccgtttttctttacgtatatgcccaattcgagcgggtcggtacctttaccgaacattggctggaaagagaaaagcttgaggaaagcagggagcttgtccgccggcagtttcaggaaaaagtgctgccgaatgaagagtcgctgtcaagctggctcgctttttttgattcggaattctcgctgtgggaggcgcggacgccggccggaagccagacgatgcagggcctttattacggctatctgtcagcgctcaaaaaacacgccccgaaaaaacccgagcttaaaagcttatatcagattcattcggcgcttgccgtctggcttcacatgttcactttgattgagtcaggcagattggatgccgaaaaagattattacagcattaatccatacgtggaacagctgatggatacgatttattcctccattgacagactgaaaacgtacgccttgtctttttcactcgatccttttttagaccggacgcccccggtgctccgcagactgcttgtgaaagaagagctttttcaatacgaacgcctccgggtattcggtgaaatgtggagcgcgcttttgaaccggccgaaatgggtcgcgcgtgaacaagagattctcgaacaggaaagcgggcgccgtttttcgccggaagtgcggttcggacggcttcatctggcctttttgcaaaaagatgatgaagcggtctttgaagatatgtcccgcttccctcctgaagcgctgccgtacacttttcaatggctcggtgaactcaccgcgaaaaaagactggaaacggctgaaaacatggtatggccggatcgaaccgcttgccgtgaactatacgaagcttgataagccgtttaaagaaatgcgcgacatcatcggagagctgtttgcgctgttggcggattatgcgcggcactcacgggatgatcagctgtttgaacggtttgcttccggctgccttccctatacctttaccgaatacagccagtacctgtacgaaaaacggcggtacgcggaatgggtggagattcacagcctcgtcggtttttccgtctgggaaattgaaaaggacatcctgaaggaaattgccgccagtgatccggaagcgctcatcccctcctatcaccgggcggcggccttttttatcgaccaaaaaaaccgcagcgcctataaagaggctgcgcgccatctgaaaaaactgcggacgctttataaaaaggcaaaaaaacagcaggtatgggagcgttatatcagccggctgagcgcaagctacaagaggctgcgcgcccttcaagaagaattgcagaaaggaaagttgattgatggcgagtcttaaggaaattttcattcatgtagaacaaatggaagattggacatttacgctgtcaagccatgatgagaaggagcagccgcttactctcagtcagatgaagactcatttgttccaatggcatgagtccaccttttacggaacgtttcttgaagacgtcagcttcatcggcactccggccgttctgctcagcccttggatgaccgtcgagctgcttggaaaaaactcgttcaattcattcagcaccgtgcagctgacaaaggaaacggaaccgttaatcgaagcggcttcgacgatatacgaatttattgccgacggcgattttcttccggattatgacgcatggcaaaatggcctcctgcgcttcaaagaccgcgagcttttgctggaaggctttacggcagactggttctcagccgcggtacaggactacattcagtacaatgatgacctgctggaaaaatggcggcggatcgaaacccgttcgccggccgttcatacgtttaaaggctcctttttggatgaagaggattttctggagggaatcggctggcatgacgatctgacgccgtttaccgtcggcctccgattaaacgagcctgatttcgacggtgacgactggaaaatcgagatgtttttacgtgagaaaaaaaccggctccatcacctttttcgacggactgaaagggctgaaaaaagcgtggcaggcatacagcggaaaaatcgcgcgtgaacaggaccgcttccgcagaacggttccctggctttcgtttgattcaggaacgacgctgatatctgaagaagaggcttggatcttcttatcggaagcgagtgagacgcttgtcgatatgggtgtggagattcttctcccatcatggtggcagattgtccgggacagcaatatgatgcttaaggcgaaagtgtcatcctccccgcggggcgagtccttcgtcggcatgaacgctctgcttgatttcaactggagattcgccacgaacgggattgagctgacagaggatgaattcaatgagcttgtcgcaaacaacagacgtctcgtcaacatccgcggccaatgggtgaaaattgatccgcaatttattaaacagatgaaaatactgatggaaaaagcggaatctgagggcctccacatgtccgacgtgctggcgcgcgaactgatggatcacggggaaaacggagccgaggacacggacatcattgactcatcggcatttgccgggatcaagatcgaattatcaaagcatctcagaagcctgatccgcaaactgacggatgccggggatctgccggagcatgaagtcagcgccgcgtttcagggccagctccgcccttatcagatgtacggcatgaactggcttctgtttttacgggaaaacggcttcggcgcctgtctcgcagatgacatgggacttggaaagacgattcagatgatcgcttattttctccatgtgaaggaaagcggccggcaaaaagcgcctgccttaatcattgcgccgacatcggtgctcggcaactggcagcgtgagctccagaccttcgcgccgcagctgaaggccgtgcttcattacggcccccgcaggccgaagggggaagcatttgtcccggcctatcaggacgcggatgtcgttcttacttcttacggcctctcgcacgccgatcaggaagagctttcttccgtgacatggagcaccgtctgccttgatgaagcgcaaaacattaaaaacgcgcatacgaagcagtcccgcgcaatcagaaagctgaaaggcgtccatcatatcgcgctgagcggaacaccgatggaaaaccgcctgacagagctttggtcgatctttgattttatgaacaaaggctatctcggcagtctgaccggctttcataaacgctatgtgctgccgattgaaaaagaccgtgacgaaaaaagaatcaaccagcttcagcagttaatccggccgtttttactgcgccggacaaaacgggatgaagaagtggcgcttaatcttcctgacaagctggaacaaaaagagtttatcccgctctcagccgaacaggcatccctttatgaacagcttgtcaaagatacatttgaacatatggcttctctgaccgggatgcagcggaaagcgctgattctgagcatgctcggccgcttgaagcaaatatgcgaccatcctgcgctctatttgaaggaagaacagacagagctgttaaacgggagatccgtcaaactggaaaagctgcttgacttaatggcggcgatccgcggacaaggggaaagctgcctcattttcacacaatacattcagatgggcaacatgatgaagcgcctcctggaaaaaacattcggagaaccggttcagtttttaaacggaagcctgtccaagcaggaacgcgattccctcgtcgaacggttccagaagaaagaatacccgacgctgattttgtcactgaaagcgggcggaaccggcctgaatctgacggctgccaatcatgtcattcactatgacaggtggtggaatccggcggtggaaaaccaggcgaccgaccgcgcctaccgaatcggccaggaacggttcgtccacgttcacaaactcattacgacgggaacgattgaagaaaaaattgatgccatgctcgaaacgaaacaaactttgaacgatcagattatccaaagtgaaaattggattaccgagctgtcatccgatgagcttgaagaattattcaccctcagcgcatcgacgcaatcacattaaacgcaaaaagaccggctctctcggaagagccggtcttttatgtcgtccttactgttacgccgcatttgccatgaatgcgtcacgccagtcatgaacagtatcgccatacctttcacagtaaattcctgatcatatacgcaacgccgttttgatcatttgtcaatgtaacggcatcagcgatctctttaatatcttctctcgcattccccatcgctatgccttttccggccgcctgaagcattgaatagtcatttaagctgtcaccgaccgcggcggtttcagccatcggaatgccgagcttttgcgccagccgtttgagcgcctgcccttttgaggcgtttcgagacgccacttcaaagttgtgatcggcagagctgacaagggtgagatctttctgaccgctgaatcggtcccagcccgctttcagcttccgctcatcaaacgaaaatccgagaatattataaaaatccagatgctcttctttctcaaagagctcacggtatgaatgaatgtaagcaaagccggactggctgtattgcactgaagccgcctgttccaaaacggaaagatcggtttccggattggcgcttttcacccggtccatttcgatatcgagcagctgcctgccggtttcaggcgtatagatggctttgtttgtaaacacctcataataatattgattctcttcaagccatgacaaaatcccccgggctcttgtttcttcaatcgcttcacaatggtacaggctgccgtcaggagcgtggatggcggctccgtttgcgctgataatccatgtttttatgccgagcggttcaaatatggagtgcacatcaaaatgcgcgcgtccagtggaaaccacgatttcaattcccgcttgccgggcttcccttaaagcccgcttgttttcatcacttacttgatgactgctgttcagcagtgtgccgtccagatctatggcaatcagtttcacatgtcctcatcctcttcttcagattcagttacaagcaattctacgccgtgccggtcgagcagatcgcaaaaatcctgatcaggcagccgatcggtaatcagcaggtcaacctcgtgcaggtctgcatactgataaaaactcgtacggccaagcttcgagtgatcgctcagcgcaatcacctgttcagcctgacggatcattttacgctttaccatgccgtcttcttcatgcggaatcgtcaggccgttttccgagatgccgacaacgccgatcagcaccttatcagcgtgataatcccccagtttttctacaacggaagccccgtataaaaaccggtgttccttctggagctttccgccgagcaggtgaatatcaattccctcttttgcggaaaggatatcggcctgattgatcgaatttgtaataacagtgcagccggtgacatttaaatgctccgcgcaggcctgaacggttgtcgatgtgtccaggatgatccggtctcctttatgaatcagggatgcggccagcttgccgattttgtttttctcttcagaaacggttttcagccggcccgaatagcccggaacttcctgattcactgacggcagaatcgcgccgccccgtgttctgataatggcccctcgctctttcagctttacaaggtcccttcttgcggtatctcttgaaatatgaagcagcgaacatatctgttcagcggtgatccgccggtgctgtttcaaatattccattatcgcaatcagtctttcttcttgatacacgtcctcattccctttttttcgtcacttatctgtaagtaattataagtttttatcccaatatattcaatgtttttaagtatttataagcgaaatcacttctttttaaccatttttcagctcccgcacaaaaaaaccagtctttcgactggcgaatgggaaggaggtattgcggggcccgctgaaaggcgggaaatcgaggaaaaaagcatgctattcagccagcggctctttccgtttttgatccataaaccgaacggtatcagccatgacctcggtcacataaacttttacgccgtctgtcttttcatagcttctcgtctggattctgccgcttacaccgaccattgaccctttttggcagtacaatgccgtgttttcagcgtttttcctccagatggtgcagttgacaaagtcggttccggtttcacccgacgcgcttttaaaattgcggtttaccgccaacgtaatatgagcgacgggaatgcccgctgatgtaaaacggagctccgggtctttcgtcagccggccgacaagcataacgtggttaaacaagccgtctcctcctctctttttcgaggctggcttcattgtagtataaaggcttatgaaagcaaaaagcggaaaaagcctttatccgtttgggctgcttttatgtttttgtttttctttctgataaaaaaaacttttgtttttgaccgcttatgtaatatgtatttttgagcagccgcgagaaaagtttcgttttgagccagtctttctcaaacatgcggacaaactttccgccgtcccatgcgaaccagtaaaaactcagctttttatcagtcaatgaaagctgaattttatactgttccatgcggtcttttgtttcatataaaaagacgacatttccccttctgttaagatgcacctcacaatcttcctttttgcataccaagtaggaatgatcgtcttttcgccttgaaccgtcttctatatagatttccttcaggcgcaattgattcataagcatctctccatgaccatattcttttacattataatgaaaaaatagaaatgattaaatgttgaccgcctacaaaaatgatgaagcatgtcttacagcattttcccgggaaaaatgatatgtgttataataaatgaacgaaaaacatggacaacaggggtgaaaataagagatgaaaacctttaaactggttgatctgaatgtggaacgtttagataaagacgatcagccgattgaacagtttccccttttagacggattgattatcaacaaagaggacggagaaaaccactggttaattgaagcactggtcccggccgaacacttttctttttttgacatgctgatgaaaagccagaaagaagcgaaggtgtttgtaacgattacgaaaaaaagcaaccgccccgcccagctgacgggaagcatcaaaaatattgtggagctggaaaagagtatacaagttttaatttacggtcaaatggtgtcaagaaaccaccccggatcagaaagcattctggagtcgctcgtgaaagaaggctactcgggcagccggctgattgaagcgtttaaacaaaaattataatcataaaaaaggccggacgttaatcatccagcctttttttgtgccttagtcattgtgaggagcccgctgtttcagcagatctctgatttcagtcagcagttctgtctgctgatctgtttcttctgcttcttcagcctcttcttctgcttcttttttacgtctcagcttgcctattgtacggatcacgataaagatagaaaatgaaataatgaagaagttcacaatcgtttgaatgaagcttccgtacttgatatgagcatcgccgaatgtcacggccagccctgaaaagtcaagaccgccaagaagcaggccgacaagcggcatgatgatgtcttcaacgagcgacgtcacaattttgccgaaagcgccgccgatgacgacaccgattgccagatccatgatattgccccgcatcgcaaagcttttaaattctgaccacattacattcacccctttctatacaaaatgggcttttttataagcccattcgtttgtttttattctccgagcgcaaatgttaattcagcttcacacacgagctcgccgtcaactttggcaacgcctttgccgcgtccgatcgtaccgcgcgcgcgggtaatatcaacctcaagctccagcttgtcacccggttttacctgctttttgaaacggcagttatcaatccccgcaaaaaatgcgagtctgccccggttttcttctttaatcagcatcgcaaccgctccgacctgcgccaaagcctctacgattaagacgcccggcataacagggtattcaggaaaatggccgttgaaaaaatcttcattcgccgtcacatttttatatcccgccgcccgttttccttcttcgacttccgtaattctgtctaccagaagaaacggatagcgatggggaataatttctttaatttgctgagtatcaagcattttcttgacatctccttcatcgacaatagtatgtatagaaggtatatgcgctaaccaatctgtacatttggaagtatattatgaatcaatttctttttcaaccgcgctgtaaactgtaaccagctggcaatgagcctcgtccattaatgtgttatgataaataaagatttttaccctatgcaaagaggttggaagatgattgctaagtttactgaaaaacgtacgctggtgatgctgaatgagtggtatgacgccatgggaaaacgccaattcgatctagcccgttcccttcacgaacaaatcaatcagcatctccccaaattacaaaagaatgcaaagctcaaactcagatatcagctgtttttcgcacggtttcagctgctgtttgagaaaaaagacggtctgactaaattgttctgcgagctgaagcggcgcaaagatgagatggaccatgaattaacttattatttctattttttcaaagggttattccatatggtgaatggcgctccgaaccgtgctgtctgccgctttaaagaagctgaacagtacctgccggccattcaggaccgtttcgaagccgctgaattttattataaaacagcgggtgcatattacatgatgaagtcgcctgcgctctccattcaatatgtcaataaagcgctggaaatctatcaaggtgaattcggttacatcaaaaaaacgctcagctgccgtctgcttctcgccgtgaattacatagacgaggcacgctatgaagacgcagaacagctctttaatgaatccataaagataacggaccggatcaatgacaataacctgctgtgccacgcctattataattttggttttttaaagaccgcccagaaaaaagataaagaggccctccctttttacaaaaaggtattgggcaatcagcgtttcgagaaagagtctcccgtttcctacctgcattgtgtatacgaagcggtcagagcactttttaaaaccggatatgccgccgaaggacaaaccgtgctgcagaaaggtttatacatatctgaaaaagtgcagaacaagataatgaaattgaagctgaccgcgctcaacatactgtacaccgctcaggaggacccgtacgaccgattgcagaaactcgtgctggagctgcagaaaattgaagcgtgggtggatttggaagtgctgcttcaggatattactgattactacaaaaaaaagggcgattttgagaaagccgcattttttatcatgcgcggctgatcaaaacgccccttcttttatctgactgagttgattaagcccagcatttggtctcccaatgtaatcgtgcggctgttcagctgataggaacgctgagacacgattaggtcggtcatttcttttgacatatcgacatttgaactttcaagcgcgccctgctccatgccgattgcctgccggtttgcgccggtaagctcttcaatcgctgatgcccccgctccgtttacggaaaacagattatccccttccgcatgaagggcctgaggattattgacattgacgatgccgagattaaacgtctgcgaacgggttcctgccgggtctgaagcagtcagcgttccggttttgctgattttcagctgattcagcgaactgtcaatttgtatgggctggccgttctcatcgagaatgggattgcctcccgctgtcaacagctgaagcacccggtcatttccgccggccggcttgagggaaagtgagccgtcccttgtatacacccgccgtccgtccgcttctgcctgaagatattgataaggtgaggtgaacgcgatatcaaggtcacggtcggtttttttgatgcctccctgccctgagtccagctgcggagtcatgaccgttccggcgccgagacgcaggccgggcggcgttttccgcatgttcggcgaattttcctttttgtcatctatatggtcatactgctgtctgatcagctcggaaaagcgggagtccctcgctttatagcctgtcgtatcactgtttgaaaggttgctgctgactgtatccatctgctgctgaagctgatttaaggctgttgaagccgtcagcattgatctgagcatcataattgaacgtcccccattttgttacactttgccgatttcatttgcggctttatccatgcttttatcgtaagcctgaatgactttctgattggcttcaaatgatctgtatgcttccgtcatttctgtatacgtgctcgtcacgtccacattcgaaagctccgagacgccttgctttaatgaatacgagacctggggattcgccgccgcgctcggcagttcagtgccgtcggccgtgctgtataggtcattgccgtcccgtttcagattgcgcacgtcttcttccatcctgatgtcaatctgccccgccggccggccgtttgtcgtgaccgttccgttttctgatacggtgaatttttcattgtcgactgtaatcggctgtccgtttgttgataaaacaaggtttccgtttatggtaagctgattgttttcatttaatgagaaagtgctgctttttgaatagcggacgccgcccgcagtctgcacgggataaaacagctcggcgttttcattcgtttcggcattcttgggaacctgattctccataagcgcgatatccgtcggctgatcggtcgttttcaggcttccctgcgtaaacaacggtttcagctcctgcatgtatacgcctgtgttgacggaaccgattttcgtttttttatcgccttctattcggctcagaagcatctcgggaaaggcgcggattgaaccttgatcctctttgtatcctgacgtattcgcgtttgcgatgttatttgacagcatttccgttcttctctgctgtgtaatcattgcggacgttgcggtatataatccttttaacaagtcttccacctctgaaatagcattatttccagttgcctcaccggaacatttgttctataatgaaaatcagcattttttcttattatcggatttacattcccgttcgtgaagggtttgacagaaaaaaaccccattctttttcagaatgaggttttatcatcagctcagtttgcgtttcggaagcttgtccatgttatccagcatgacgccggttccgaccgcaacacaatccatcgggttctcagcgacaagaacaggcaccctcagctcttcggcaagaagctggtcaagcccgtttaacagcgctcccccgccggtaatgataacgccgcggtcgatgatgtcagcggacaattcaggcggtgttctttcaagaacctgcttggcggcctgcacaatgacggcaactgattcacgaagggcttcttccacttctttgctgtttactgtaatcgttctcggcaggccggaaaccatgtcacggccgcggatggtgatttcttcatgacgtgcgtctgggaaaaccgttgcgaccttcaccttaatatcttcagcggtacgttcaccgatcagcagcttatactcgcgtttgatataatttaagatttccatgtcaaacttgtccccagccatcttaatagaagaggaggtgacaatatcgcccatagaaataactgcgatatctgtcgtaccgcctccgatgtcaacaaccatgttaccgctcggctggaagatttccatacccgcgccgatagcggcaactttcggttcttcttcaaggtacacatgctttccgccgcttttttcagctgcttctttaatcgctttctgctcaacggatgtaatattcgtcgggcagcagatcagcatacgcggttttgagaaaagtccttttacattcagcttattaatgaaatgtttcagcatagcttcagttacttcgaagtctgcgattacgccgtctttcagcggacggatcgcaacaatattcccaggtgtacgtccaaccattcgtctggcttcttcaccgacagccagcactttgccgctgtttttatcaagtgccacaacggaaggctcattcagaacaattccttttccttttacatggatcagtacatttgcagtaccgaggtcaattccaatatcccttgcaaacatctatttatatcctccttgatatctgtttcacagtaaaatatccacattgtgccctaattatatatattatcataatttatcaaaaaaaagctgctgatcgatataagttcttgacaaaattttgcggatattcgcgaaaccgcccggaggagaaaaaagggcccggcagacgtcaggcgctacggctgctgaacgggctccccttcaagaatttcatccttcttgtactttaatttcgtcgcctcgccccccttaaatgtctgatggatttatgataatcgagtatttcttttacttcattcgccaagtcaggattgatttcaggcaggcgttctgtcagatctttgtgtacggtacttttggaaacaccaaactctttcgcaatgacacgaacggtttttttcgtctccacgatatacttaccaatcttgattgttcgctctttgatgtaatcgtgcacaccactcgacctccccagttggatgtgagaagtgtgaaatgagatccgtattctgtaacagattcactgatgatgcagcttcttcgttgtccgattatataagaaggttttagaaatatgcccacgatccctcacctcaaacactctctttgataggtttgtaacagtgtattagcaatgaattgggaatatgctaaaaactcaataaggacaaggggcgggtcataattttctgctttttgaacggggggtttacatccgcgcgatcctgctgtagaatgaaacagcacaattagttacttaggtaagttttttgaaaaggagaacggaaatgatccacgtcaacagacgcctcattcatcaaatcaatcaatgcgcccgcctgattacgaagaaagccaatgaacggctggaaccattcggcctgtactcctctcaatggtcaatcctatattgcttaaaaacgatcggaccgatgacccaaaaagaaatctggtcttatctgaacgtagaggcgccgaccgttaccagaacgatcaaacgccttgaagaaaacggctggattcagcgggaacagggagaagacaagcgggaaaagctcgtcgtcctgacgaaggaagctgaattgaaatacaacagcatcaatcaagagatgctgaagttcgaggaagacatgcttgcggatttccaagatggagataaggaagctttttctgagtttctgaatgtgtttttaacgaaataataaagaaagggaagtgctgtacttttgagtaaatctgactcgatctggaccaaagattttattatggtcgtactcgtaaatttatttgtctttgtgttcttttatacatttttggccgtgctgcctatctatatgattcaggagcttggcggcagtgaatcgcaaggagggcttttgatcagcctgttcctgttatctgctattatcacccgtcctttttcaggggcgattattgaacggttcggtaagaaaagaatgacgattgtatctctggcgctgttcgccctgtcttcttatctgtatttgccgatacacaatttctatctgctgctcggactgcgttttttccaaggcatctggttcagcattttaacgacggtcacaggcgcaattgccgctgaccttattcccgccaagcggcgcggcgaggggctcggttattttgcgatgtctatgaaccttgccatggcgatcggtccgtttctcggactgagccttgtgaaagtcatatcgttcccggtgttctttacgctttttgctgtatttgtttctttaggcttgctgattgcttttatgattcgtgtgccggatcaaaacaacagcggaacgactgtgttccgtttttctttctccgacatgtttgaaaaaggcgcgcttaaaatcgcgattgtcgggttgtccatttctttctgttattcaagtgtgacttcatatttatccgtttatgcaaagacgatccacctgttggatgtcagcggctatttcttcgtctgtttcgccgtgacgatgatggccgcccgtcctttcacaggaaagctgtttgacagagtggggccgggaatcgtcatctatccgtcgattatcgtgttctccgcggggctttgcatgctggcgatgacaaacagcgccctcatgcttctcttgtccggtgccgtaatcggtctcggatacggctctatcgtaccgtgtatgcagacgctggcgattcagaattcgcccggacaccgttcaggctttgcgacggcgaccttcttcactttctttgacagcgggattgccggcgggtcatatgtattcggcctcttcgtcgcttcggccggattccattcgatttatctggcagcggggctgttcgtcctgattgctttgctcctgtatggctggagccagaaaaaaagaacgccgcttgaagcggacggaaacgtttcaatcgcagactgatatgacaaaaagccgggggcagcccccggctttttttattcggccgctctttcccgcacgattcgtccctccgcttttgcataaggaggatgaatgtacataagcgccgtataaccgagacatgacaaaatgacacccgcaaaccaggagatatcatagatgccggcgaacgccgggacgtacatcccgattaaagaaataaacgcgccgagaaacgtcgcggcaaaggcccggtaattatagcctttgtaataagtgtactgtccggtttctgaataaaggtcttcaactgagagctgcctttttctgatgataaaataatcagccatcatcaccccggccaccggtccgagcatcccgccgatgagtccgagaaacgcatatacattcgtggcgctctccatcagcttccacggtattgtgaacagagccaaaacggcggtcaaataccctccccttctgaatgtaatatacttcggcaggacattcgccaagtcataggccggtgacacgatgtttgccgccacgttaaccgagacggcggcgatgcaaagtgtgatgaccgaaagagcgataacgaaaggattatcaaaccgggccaaaatctccaccacatcccagatcggttctccgaatgctacctgtgatccggatgtcaccgtgatgcttgcaaacgcaaacagcgcaaacgttcccggcagcccgtaaaactggccgcgaatctgttctttttgcgacgcggcgaaccgggtgaagtcagggatattcagaatcagcgtcgcccatattccgataatgcccgtcactccggcggcaaacggccaaaacgtttcagaaaatgtatggaactttcccggctgtgagtaaatcggaccgagcccgccggcaatatctatcgcccaccagaccatgccgccgaagacgagataaacaagcgggcccgcccacacttcaaattttttgatcgattccatgccgtgccgcagcacaagcagatgaatgccccaaaagaaaatgaacgacagaaagcccggcagatgaagcccgaatatattccaatctccgccgagactcccccagcccggccatatgttcaaaagcagaatgtgtaaggcagtgctcccggcaaatgtttgaattccgagccacatgatggctgtaaatgccctgagaagcgccggaatgttagctccgtatattccgtaagaagccctgataatgaccggaaaaggcaggccgtatttcgttccggcatggccgttcaaggccaaagcggcgaacaaaatcagtgacgccgtcacgataatggcgagcacctgccacggagaaaggccgatcgcaatgagcccgcccacagtcgcgtaggtcgggatattatgaatacaacccatccagatggatgcaaaattcaccgccttccatgtccgttcgccgtcttctaaaggcagtaaatctttgttgcttagccgatcactcgttatttttgtcattttctccctcctgcatgtacgttttccttacatcacatgtgaaaaaatataactgaaaattccgcaaataacattggtcgctgtcgacaataatcgttttgatttttgagcacattacacaaaaaaagagacggggagagcccgtctcttttttttgcgcctgttaagaggcttttttgaggagaaccgaaaaccggaacgccatcaaaaggcttacggcgccgacaacgataagaatcgtgccgagcatatgaaaatggccggcggtaatttcttttccgaaaagaatgcccaaaatgacagaagacaaaatcgaaccgagatacctgcaggtctgaaacaggccggacgttgttccgaccatgtcggcggggctcgttttcagcatggccgcctgaaacgtgacatttccgaaaccgtagccgacacccagcacggacaggatcagcccttttcctatcatgggcgcctgaaggaagaaaaacgttaacagcaccgctccgatcgcggtcaggcaggttccggcaacaatcggctgaagaagccctttcttatctatccattttccggtcaaaggcgacaccagaatactcatgcccgacataaacagcataatcaatccgcttgtctgaacggacaaatgcatttcatcctgaaaatagctcggaagcccgaaaaagatgcagtaaaagaatatattcagcaaaataaattgaatatacaccgacgatagtttccgatgcgttttaaacagcctgacatcaataaacggcttctctgttttcagctcacgccagataaacagcccgacaaataaaagcccgaatacgccttctgtatagtgaggcttcgtactgaaggacaataaaaacgacaggagaaggataatcgctccggcaaacaggagtatcccgattgtatcaagctggcggagcacgcctttcaagccgccgatctcgcgtttttcatctttcggaaacatatacattccgagaaaaaaactgaggatgataaacggcagattgacgaaaaagatcgccggccaccctccccaaacgatcagaaaaccgccgagagtcggaccgagcgccgtcatggctgatgcaaagattgacaggacggccagcgccgaagcctgcttctcctgtatatttgaacggatcaatccgacgccggacggatatatcgcgctgcttccgatcgattgaaaaagccgcatgatcagcaatgtcataaaagtcggcgcaaacggcgcgccgaccgccgagacggcaacaagcagaagcccgatcaaaaacagcttcttcctgccgagcatatcaccgagcttcccggtaacaggctgcgccaccgcgctggcaagataaaaggacgatatcagccaggacaccgttgtaaacgacaggtgaaattcatgctgaatactgtgaagcgcaagagaaatcatcgacgagttcaatgggttcagcatcgtccccgaagccacggccgtcaagaacaggacgcggctttttttggagattgtcattttgtctgtgcgataaattcttccgtcgtccggcttctgccgattttcgggaagataaatttgagtgtcgcttcgtgctgttcatcgctgaatgtcgccatcgcgtcagttacgaaaacttgctgatacccgagctgaaaagcttcccgcgccgtgctttccacaccgatgtttgtcgcaatcccgcataacacaatcgtgtcgattccccgtcttctgagctgaaggtccaggtccgtgccgaaaaacgcgccccactgccgttttgttaccgtataatcgttttctttcactccgatttcaggcacaaattcagcccaatccgccggcggagccgaatggcccgccgcctcttcatccgtcagcggcttcagcgcatccgctccgtcatgaaaatctacgttcacaaagctgataaatccgcctttttcccggaacacatcaattaattttttcgcgttcggcacaacggtaccgcttttatccatcggcacaatgcctttttgtaaatcaataaggaccaaagccgttttttcaaattgcagattcaatgatgttgtcataataattcctcctgatgcagttagtgtttctcaccccgtttattttactctttcccggacaggatttcttccgccatgctccagcgctctttttatggatataaagtcgcatgacacccctttgaaaaagcgacattatgaacgcaaaaaaacatgtcagataaccttacacgaaaatgttttatcgttcttttttctctataataatgaattaatcacgattacattttgaatgagacggaggaatacaacatgcagatgggcgatacagtatttatgttcttttgcgctttactcgtgtggctgatgacccccgggctggctttgttttacggcggaatggtaaaaagcaaaaacgtgctcagcacggcgatgcacagtttttcttccctcgccatcgtatccgtcgtttgggttttgtacggatattcacttgcttttgcccccgggaatacatggcttggcgggattgaatgggccggactgaagggggtcggctttgaacccggaagttatagtgatacgatcccgcattcattattcatgatgttccaaatgacgtttgccgtactgacgacggccattatttccggagcatttgctgaacgcatgagattcagtgcttttcttgtattttcctttttgtgggcttccctcgtatatacgcccgttgcgcactgggtatggggcggcggctggatcggccaaatgggcgctcttgacttcgcaggcggaaacgtcgtccacatttcttccggggtcgccgggctcgtgctggcgattgtgctcgggaaacgcaaggacggcacggcggcttcgcctcacaacttaatttacacgttcttgggcggggcgctcatttggttcggatggttcggcttcaatgtcggcagcgccctcacgcttgacagtatcgcgatgtttgccctcattaacacaaacaccgcggctgcggccggaattatcggctggattttaatcgaatggatgctgaacaaaaaaccgaccatgctgggtgctgtatcaggcgctattgccgggcttgtcgccattacgccggctgccgggttcgttacgccgttctcttccatcgtaatcggtttcatcggcgggcttgtctgcttctggggcgtgtattggctcaaaaagactttcggatacgatgatgcgcttgacgctttcggcctgcatggaatcggcgggacatggggcggcatcgcgaccggtttattcgccaccacttccgtcaatgacggcggggcaaacggactgttttacggcgatccgggactgctctggaagcagattgcggccattgcggcaacctatgtatttgtatttattgtcactttcgttatcattaaaattgtaggtctgttcattcccctccgcgccagcgaagaagaagagtcacttgggcttgatttaacgatgcacggggaaaaagcatatcaggacttataaagtgaggagtggcttagatgagcggtcaaatgttcaaggtagaaatcgttacgcgtccggctaagtttgaaacattgaaacaggaactcggtaaaatcggagtcacatcgctgaccttctccaacgtacacggctgcggccttcaaaaagctcacaccgaactgtaccgcggagtcaaaattgaaagcaatgtatatgaacggctgaaagtggaaatcgttgtcagcaaggtcccgttgatcaagtggtggaaacggcgaaaaaagtgctgaaaacgggagagcccggcgacggcaaaatattcgtctatgaaatcggaaacacgattaatatccgcaccggagaagaaggaccaggagctttataaacagacagaacgcccggagacagcatgtcccgggcgtttttttcgggcttcattaaaaagaagaagcctttttttcatgcggggcaggacgcttatgccgtacggtttgttttttcgcatatgtactgatattgaccagtatgccgcacaaaaacagcgtcataatcaatgaagaaccgccatagctgataaacggaagcggcacacccgtaaccgggaggagtccgctcatcgctcccaaattcaagacaacctgaaacattaattgaaacgtaattccgatggcaagaagcttcccgaacgggtcatcagcccgcacggccgtttttacgccgagaagcattaacgcaaaatataatcccaaaacgatcagaacaccgaatatccccagctcttcactgatcacggccataatgaaatcggtatgcgcctcaggcagatagttcattttttcaacactgtttccaagccctcttccgaaaaacccgcctccggaaatagcaaaataggattgaatcagctgatagccgtccccgttcgcgtcaccaaacggattggtaaaggaaacgaggcgcttcacacgataggatgcagaaaatgcgagataaacaacccccgacaccgccgtcgcgccgagcacgaaaagatggcgctttttcaagccggcacataataaaatcgacccgcacgccgccaggattaaggaagccgtccctaaatcaggctccgccaaagtgagcagaaaagcggtccccaaaattactaaaggcggcagaacccctttcacaaattgatgaatgtacggctgctttttcgtataaaccgaagcgaaatacaaaatcatggcgatcttcgccaattcagacggctgtacgacaagcgggcccgctcccagccacctgcgggaaaaattccgctccagcccgattcccggtatcaatacgagcagcagcaataccagcgaaccgaccacaaacagcggtacaagccgcgcataccgcttatacggcagacaggcggcaaatagaaataagcataatccgatcagtaaagaggcactttgtttatggaagaaataggatggatctccgtaccgctgagaccccatcacatcactggcgctgtacaccattaacaagccgaatccgcaaagcagcataatgacaaacacaagcggcagatcggcgtttttcaaacgtttcagcaacggacaaaactccttcggctattcttttcccgcatacttgacgcacagtaatacagtcacgtttcattctgtttacttttttatgattatttttaataccaattgtgtctcatagaaaaaagcattacactgttcatataaaataaagataaaaggtgatatttgtgaattacgaactatttaaagcgatcaatggtttgtcgcaccatagtgccattctcgactctatcatggtttttataacggaatacgccatttacgcctacgcccttttcctgcttgccatgtggctgttcggaagcacaaaaggcagacaaaacgccctgtacgcgggcttcacgggtgttgcggcgcttatcatcaactacctcatcacgaaagtctatgtcgagccgcgcccctttgtcgagcatacggttcatacgctgatccctcatgccgcggatgcttcattcccgagtgaccatacgacaggcgctttggcgatttcaattgcgattctgttccgcaacaaaaaactcggctggccgcttgtgattttcggccttttgaccggcttctcaagaatttgggtcggccatcattatccgatcgatgtgctcggaagcattatcgtttccctcattgtcggattcctgctgttcagattttcaaatgtgcttcgtccgattgtcgatctgatcgtgcgaatctatgaaagtatcgttcataaaagcaaatcgacaaaccataatatataaaaaaagccggcgtctgtcacagactgccggtttttgtatgtttggctgtatgctttttcctttgtaaagcccagaatgcggcaatgccgagactgtcaatcagcacatcgcggaggcatccgtttctgccgaaaaagagctggacgatttctgtcaggaaagcggcggccaatgcatacagcaccgccctcttcatgcgcctgcgctccctgaaaaacaaataggcgagcacaaaaaatgaaaacgcgtgcccgagcttttgaatcgccgcttccggtatggcgagctccgccatatcgaacacaaagaaaccggacacatccggatgggacgtgaaacggaaggacaccgtctgcgacacaatcatatcgtgaaagctttcagtcaaagcagaaacgaaaacaaagacgagccacccggccgccagacatttattcattcagcatctccttcgttttctattagtataaaggcacatgcagcaatatgaaaagcgcctatcagagctgatagacgctttgggatcaagattacttgcccgaatctttcattgagccgtcatctttaccatctgtcttgtcttttgtgccgtcttctttgtcacctggtttttcttcggtttcttttttaggcgtcacatcttttttctcggaagactgctgaattgacccttccgtttcttctgtcacagcgtttttctcttcagccgccgctttttcaatagatgttaccggcttgtccataaaattgagcgggttcatcgctacgccgtccttgcggatttcaaagtgcacgtgatttccgctttcttcactgtaaagattttttccggatttaccgatgacctggttctgctttactttgtcgccctggtccacgctgacttcagataaagactgatagacagtagacaggccgtctgagtgttcaatttcaaccacataccccagtaccgggtctttagcagctttaacaaccgtaccgctcagagaagcagaaacatcaaatgattttccgtctttctcagctaagtcaattcctttactgaggctgtacgtgttattatagttaacaagtgctgcttctttctctttttttgcggcatcagattcgtaaaactttttcacaacagaaacattttcagaatgagcagccggcattgcgacgttttccattgacttgcctacttcgacggcatcgtctttgccgctgtcatacgcggagtttccgccgttgttcgtcagattgtccttcacatcattcgaaacggattgataccaaaggacagctgttaaaatgacggccgcactgactaagtagattgcagggaatatccagcgtttgcgaaaaaaccgctgaagttttttgacttgagaagttttcttttcttcctctctcatttgttcatcacctcagcaacattctgaacacttttctgaaaatatatacacatccataaaaaacttttttagaagtagtatgtgcagattgcacttaattatgtaatgaaatgtgaagggagatcccggaatatgaatttaaccctgcgcaaagccgtattggaggatttagatgcggtggtggccatatacaactcgacgattgcctcacgaatggtaacggctgatacggaagaagtgacgcccgcagaccagatggattggtttttgcggcacacggaccggcgcccgctgatggtcgcggaagatgaaaccggcaaagtggcggcctggatcagctttgaaacgttttacggccgtccggcctatgacaaaacggcggagatcagcatctatctgcatcaggattgccgcggcaaaggagcaggaagctttctgctgaaagaagccctggcactcgctccggcaatcggcatccgcagcctgatggcttttatcttcggacataatgtgccgagcattaagctgtttgaaaaattcggttttaccgaatggggcgtattcccgggtatcgccgaaatggacggaaaacgatatgacttgaacattttagggagagaactgtcatgatcaccatcgataaagacaaagacgaaaaccagccgctcaataaaaaagcccgttcccttgccgacatcgccaaatggggaaagatcaccgccgtgtttctgatcatcacaggttctctttccgctctgtcagccattgtgacgctgctcggagccattccgggtgttctgctcatcatttccggcgtcatgctgatgcgctcggcaaaagcggctgccgcccttcaggaagggctagaagaaaacgcggaagaaaatatgcttgcacattatgcgtcatttatcaaaatgcagtttttttacgcggcatccagtgtggtactgggcattctcgcttttattttagtcgtcatcttcgctgtcatcggaattatggcttattacagcactgatacgtatgacacgcctgattcatattactatgagaacgatcctgtgtttgaatgacaaaaagagctgatcgcgcgtcagctcttttttaatacagcatttcttttttccggtcttcttccgttaaaaattcaataaagctcttcatcgcagacggctcctcggcaatcagccgggtgtaggcgcttttccgttcctcggacagaatatcgctttttctgattctgttcagcatataaagccggatcgttttttgcacctgtttccgctgatagccggcttccttaaaaaacgcaagacccagagccgcaaggagggcaaaaatgccggccgatacgagagctcctctcccggaaggggcctgaatcaaaagcgatgccagatgaaacagactaaaagcggcgagcgggaaagcaagaaaacggtaaatgatgctttttttcatcagcggcgcgatggcgatttgtattttctgaatttctttttttatgaatcccggcaattgttccgcatgctccagcttcatgccctctcccctttgctgtcatttttgtcttctttttcatatatgcatattttaccgcacccggaactttctttgaaagaaaactgcattcatctttgattccggctctttattctttcaaaatgtcaatgttataatttgaaatgggaatcagattgctgcacttgtcggaatactaatgggcacagtcttgataaatatgatatagcggggttgcaaagtgagcatttcatttattttattcggattttttttcgttttaaatatacttttggccgtcatcatgattttcaaagaaagacgcgatgccagcgcttcatgggcttggctcttggttcttttttttattcccattttagggtttattttatacctgttattcggccataacctgagacgcaagcacctgtttcaatgggaagaccgtaaaaaaatcggaatagaaaagctgctgaagtttcagctgaaagatctgaagtcgaggcaattccaatttaacaacagggcgactgtggataataaagacctcatctatatgcttgtcatgaacaaccacgcagtctttacagaggataattcggtggagattttaacggacgggcgcgataagttcaaacgcttaatgaaggacatttccaacgcaaaagatcacattcaccttcaatactatatttataaaggtgatgaactgggaaaaaaattgcgcgatgccttagtgaaaaaagcacgggaaggcgtaaaggtcagagtgttatatgatgaactcggttcaagatcactcagaaaaaaattcttcaaaccgctgcgggacgccggcggccatgtggaagtcttttttccttccaggcttcgtccgattaatttgcggctcaattatcggaatcaccgcaagctcgtcatcattgacggcgaaaccggctatgtcggcggctttaacgtcggagatgaatatctcggcctgaatccgaaattcggctactggcgcgatacgcacctcagacttcaaggcacggcggtacacgccattcagacacggtttattctcgattggaaccaagcttcccatcaccatacgctcacttacgttccgaatcattttccggaatgcgagccgaagggcaatgtcgggatgcagattgtcacgagcggaccggattcagaatgggaacaaattaaaaacggctatatcaagatgatctcaacggccaaacggtcgatcctgattcagacgccttactttattcctgactcaagtcttttggatgccctcaggatcgcctgtctgtcaggcattgacgtcaaaatcatgattccgaacaagccggatcacgctttcgtttactgggcgactttatcttacatcggcgatcttttgaaagccggagcctcagtctacatttacgataacggctttattcatgcaaaaacgattgtcgtcgatgatgagacggcttcagtcggtacggcgaatatcgacgtcagaagcttcagacttaattttgaagtcaacgcctttatttatgacgtcaccatcgcgaaaaaactcatttcctcatttaaagaagatctgctcgtctccagaaaatatacgtatgaagaatatcaggagcgttcgctgcggatccgcattaaagaatcgatttcaaggcttctgtcgccgattttgtaattcccgggatgtttctcgggaattttctgatataaaaacggacacagcttgaaaaaacacattttatattcaaaagaatgaccgaatagtgtataaatgaaaagtgagtatttttttgtaaaggagtgccatggtttgaaacctgaatcagtgaatcgttcgcttatttctatttcgaaatggggaaaagcgacaggtattttgtttattattataggcgcgtttgcggcgctttcgggcgcgtttttctttttaatcggagccattcccggcgttctgcagatcattgccggcatttttctgatgcgctcggcaaatgaagcgggacagatggcggcgcagttcaatgaactgacagaggaacatatgctggagaattatgcaaagttcgtgaaaatgcaggggatctatctgatcgtgacggtcggcttgtccgttctcggtatcgttcttttcattgtcctcatgacgctcggcatcgtggacgacgcgtttaataatattgatgccaatacatattaaaaaggaaaatcccggcgcatccgcccgggattttttcttattccgcttctccgacaacggtaaagtttttctgcttcggatttgccaatacggcgaacagcattgacgctgtatgcagatattctttcggcaaaaaagttttttcaaataaaacgtttcctcagagttttaactgaaatcactgagttctgcgaaataaggctatggcggtacaagaccactcatcatacaattttttgggtctttgtaattaaattacaattgttcttaatattcacccatgtattcatgctattatattgaaaggaacgatcaaaagcgttggcgttcgttaaatatttacgagtgctgcctcatgtcaaagtcagaaaaaatagtataggaggtaacatatgtttaagtttaaaaagaaattcttagtgggattaacggcagctttcatgagtatcagcatgttttcggcaaccgcctctgcagctggcacagattactggcaaaattggactgacggggcggaacagtaaacgcagtcaatggctctggcggaaattacagtgttaattggtctaataccgggaatttcgttgttggtaaaggctggactacaggctcgccatttagaacaataaactataatgccggtgtttgggcgccgaacggcaatggatatttgactttatatggctggacgagatcgcccctcatcgaatattatgtggtggattcatggggtacttacagacctaccggaacgtataaaggtaccgtaaagagtgatggaggtacatatgacatatatacaacgacacgttataacgcaccttccattgatggcgataacactacttttacgcagtactggagtgtccgccagtcgaagagaccgaccggaagcaacgctgcaatcactttcagcaatcatgttaacgcatggaagagccatggaatgaatctgggcagtaattgggcttatcaagtcttagcgacagaaggatataaaagcagcggaagttctaatgtaacagtgtggtaacagctcatctctaatgaggggcagctaacgggctgctgatcgttccttgagaaattttataatgattgtgaagaggcgaacggttttggcattaccggaggcaggatattctccatcagtttttttagcgcgtattaaaataagagttccgtctttttttggtaacccgcttacaacagacaccttcacataagccttaagcaaaataaaaatatcccggttaccacctcctttagtttcggaggttttcttcattaaacagatcgcaatcccgcatccaggcttgtctgaatatggagccaaaaccgtgatttcctcattacccattgtaaccatttccgttacacgtctagcggcatgaacccatctctttttaacaaaagagatgattcattacatcataaagggacttgctcgcaagttcattctccattgcccgctgtacgcttccgaacgtctcatcgagcgcgcgctgaatatttttgccgaccggacagtcgggattcggattgtcgtgaaccgcaaaaagctcttccttattctgcaccgccctgtaaacctctaagagggtgatctccgacggatcttttttcaggctggctcccggaacacccgcccgggatgtcagaatacccgcttttttcagctggctgatcgttctccgcactacgacgggattggtgtttacgctgcccgcaatcatgtccgatgacgcccgttcatccgttgagatcagcgataaaatgtgaatggccacagcaagacggctgttaatcatgtttttcaccaccattgtaaccaaaatagttacatttcatttgtttgtcaactactaatatacactaaaacgggcggcaggatgaaatcaagttggcaatagagggtaaacaggccggcgggaaaccggccggagagggattaaaataagaaataacgctgtcctagcggaacatagctgacgggctggcatgccagctcttctccgtcggcgaacacctgataggttttcggatcgacatgtatattcggcatcgcgtcattcagcttcatgtcgagcttactcagcttacggatattccgtacgggagaaatcattttttcaaggccgagcttttccggcacaccgtttgcgataccggcctgggacataaatgtaatagaggtattgcggtttgctttaccgtatgatgcgtacatctgccgcataaacacgggctcaggcgtcggaatggaagcattcggatctcccatctgggcgcgggcaatcatgccgcctttgagcacaagttcaggtttgacgccgaagaaaaccgggtcccatagtacgaggtcggcgagctttcctttttcaacggaaccgacttcatggctcagaccgtgagtgacagccgggttgatcgtgtatttggcgatatagcgtttggcgcgcacattgtcattgctgttttctcccgatagagcgccgcgctgttttttcattttatcggccacctgccatgtccggataatcacttctcccaccctgcccatcgcctgcgagtcagatgacgtcatgctgatcgcgccgatatcgtgcagaatatcctccgccgcaatggtggccgctctgatgcgtgaatgactgaacgccacgtcttcaggcacttttgaatctaaatgatggcagaccatcatcatatcaagatgctcgtccatcgtgttgacggtatatggaatcgtcggcgtcgtagaggacggcaggatattggcgtaagatgcgagtttcataatatccggtgcatggcctccgccggctccctctatgtgatatgtatggataacccggtcgccgatcgcatcaagcgtattttctaaaaagcccgcttcatttatcgtgtctgtgtggatcgccacctgaatgtccgcctcatccgctgcttccatgcaagctttaatggcgcttggcgttgatccccaatcttcatgcagcttcaggccgattgcgcctgcttccacctgctcgatcagcggcgctttatcggatgcatttccttttcctaagaaaccgacattgatcggaaactcctcggccgcttccagcattctcgacatgtaccatacaccggatgtacaagtcgtcgctttacttcccgtcgcaggacctgttccgccgccgagaagcgtagtcacgcctgaagaaagcgcgacttccatctgctgcgggcagataaagtggatatgcgtatccaccccgccggccgttacgattttcccttcgccggaaatgacttctgttccggcaccgataatcatgtgcgggtccaccccatccatcatatcagggttgccgcttttcccgacgccgacaatccggccgtccttcaccccgatatccgccttgacgattccggtataatccaggatgacggcgtttgtaatgaccagatcaagcgctccgtctttcccggtgatacgcccgttctgccccatgccgtcccggattgttttccctccgccgaaaatcatttcttccccgtaattcgtgaaatctttttcgacttcaatccataaatccgtatctccgagtctgactttgtctcccgttgtcggtccgaacagttctgcgtattgctcacgtgacattttcatcggatcgcctcctccatccatccggcttttttaagatttgacagcgtcttctcttttccccgctcatccatatacgtatcggccatgccgttgaggcctctgaccgtttttcgccctccgatttccacgagcgtgacggttttctcttctcccggttcaaaacggacagatgtgcctgacgggatatcaaggcgcatgccgatggctttgtcccgattgaaggaaagggcgccgttggcttcggcaaaatgaaaatgcgatccgacctgcactgaccgtgttccgttattggtgactgacacctccagcgtcttccggccttcgttaatggtgatggtccctttgcgacttgaatcgctcccggcttcatgacttcacctccgctttgatcggctgatgaacggtgacaagcttaaccccgtccgggaacgtcgcttccacctgaatgctgtccagcatttccgcaacgccttccataacgtctttttccgtcaatacattgcggccggattccatcagctcagcaacgctttttccgtctctcgcgccttccatcagataacaggtcaaatatgcggcggcttcgggataattcagcagaacgccgcgcgccttccgctgcttagcgagctctcccgccgtaaaaataagcaatttttcttgttcaaccggtgtcagtttcatctgtattcccccttagtgatagtcaaacacaatccgcatggtcataccgaaacgatgcaggcggccgtcacccccttcacctcatgaaatgttaagtgataaaagttattcgacagtgaacggcccgattccttttgcagaaatgaccgatttctcatttttttcttcaacaaacgtttaattaaatgtgaagaaaggttacattctttgtgaatattataaagaaatcgccggggaatttatagaatatttaaaaatttagtgaatattaaccaaacgaactggaatttttgtcatttctcataacaaaaagcccaaaatattttgggcttttgctgtgtttcacgatcaaattaatcatcactgagtttatctttcgttttaccgacacccttttgcaggctgcctttcgctttgtcttttttcccttccgcttttaagtcggacttgtttgccatgtcgcctgctttgtcctttgcttccccttttattttgttcatgccgccttttactttgtcttttaaaccgttatcttcactcatgatctcttcagctccttttgtttttgtgtacttgttttcttccctttcagcctgatagcaaacatttcaactctcaattattgatttcacagcgttccccgtagcggatcactttgtaaacggccaatccgtctgacagcttattatccccgtattgcacgggcagaagagcaaagaaaacataataagttgaaaaatagacaaattggtaaaaaaataagtttggctctaggaaatcttttatgatcagcagatttattaaaaagatagaagcgagattaaacagacagcctccggaatagacgagcgcgctcgtcagacggttatctatccgcaattcgccgaacttgcagaaagaatctatgaagtagatacgccgaacctgaatcggccctacttttaaaagacgtttccccattccgatatccaacgacgccttgcctccgaacagcatggccataaagctgtgtcccgacacatggatgacagacaccatcgggagaatgatgagaaatgaaacgaaaaactttatcatatcattaaatccgaacaacaaatccctccttcccatcgtacttttttccctcttttgcgatttttccgattttttctatgatcaaacgtcctgatgtgcataaaaaaataaccatctgctgatcagatggttaacaaaaattatatatcgtataaacactgttctttttgaattttttctctcatgcgaatcgctttttcataaaaatacgccgcttctttatattgctcatgtgcgcttgtgtaaacggcggcctccaaggcgaaatcttcaatatacacatacagcgatttttcattcatatagtcaaacacttcatggattaaatccatattgagtgactccaaataaagcgcttgtaaaaacttatacttctctaaactgaatcggtcgccgcgttctttcgcgatcatgatccctctttcataataggtaagggccgcttggtcatcatgcagcctgaaaagggtgtgcgttaagctgaacagcgccttcggaagctgttcaagctgatgctcttcaaaaacgggaaccgcttttctaaagtaccgggccgcttcatccagatcccgcttttcagcataacaattccccagattgtaaagcgaagacccgatcaggcggggctgtccttcaagcaaagaaaggcggagggcttcgtctaaatgctcaagcgctttgtcgtagtttttgcagtcgatgtagtttcctgaaatgacgaaatggcattgaattctccgcactctgtaaaaatcgtgtttcatatacgtatccagcgcctgaatcccgtgattcatggaaaaatgagtctgcttcatgacgtaaaaaacttcagacatcttgaaatggaattccgccctctctatatcatcctcgacaaatgaaaggagtttttccgctttccggtaaaaagaaatagccgcaacatagttattgtgatcgaattcatacatccctctgaacaaatggaaataatactcagacagtcccgatatgctgtccgtgctttcgatcgtcttttgcagctcgctgtactgaatctgtgattgttcggtgcattccggcttgacgtaatcaagcataatatgatggcggtagctgatcagctgataatataacagcagcagctggtcttcctccatacgttgtatatcctcatcaatttcctctttcagctttatggcatcagccgcttgaaacgctaaaatgtgcttgtaccatttgttgatcttgactccaacttgagatgacggaatctcgtatgcggtcatgcccctttcacaaccttttctaatttctattggttatattttaacatattgtatggctttggaattgcataacttgattgtcctgcatcaaaattcctatcatatatttcggctgttaccggtattttttgaacagaccgctctcatattgtgaataaaaaagcctgcccttgtccgggcaagcttttcttcatccgcctatataagacatttccactttctttttcccatccgttttagaaagcgcgcggtcaattgaatactgatccgcgcgatttctccagacagaagcgatggattccgtcaattcatcatcggtcagaccgccgcgcacgagtttccgaacatcatagccgcttgacgcaaacaggcacgtaaacagctcgcctctcgccgacaggcgcgctctgttgcaggaggcgcagaatgcatccgagacggaggaaatcacgccgatttcgccggaaccgtcaagatagcggaacctggaagcgacctctcctttgtaattcgcttctatcggctccgtcggcatgtgctggttgatcagatcaataatttcggccttcgtgatcacgtcttttttattccattgattcgtattgcctacatccataaattcaataaaccggagaatatgacctttttctttaaaatagcgggccatcggcaggatatctttttcattgacgcccttttgaacaaccatattgattttcacaccgagtccggccgcttttgccgcctcaatgccctcaagcaccttgttcaccgaaacgccgcggccgttaatggccttaaaccgctcatcctctaaagaatcgaggctgactgtcactcgatgcagccccgcctgcttcagtttttccgcatacacgggaagcagagagccgtttgtcgtcatcgcgatatctttaagtcctgggatgcgcgcaagttttttgatcaattcaggcatatcttttctcatgagcggctctccgcccgtcagcctgattttttcaacgccgaagcggccgacaaacagcttcgcaagccgctcaagctcctcgaaggagagcaattccgtcttttgtaaaaatggataatccggtccgaataattcggctggcatacagtacgtgcatctgaagttgcagcggtcggttacagagatacgaagatccctgagcggcctttcctttttgtctgtcacccggcgcgtttctgtattcataagcccaagacccctttctattgttcaacccgttcaggatgtgtgtatacgttaaatgatccgtttctgacaaaaccgatcgcggtgatgttcagctcttccgccatttgcagcgcgagctccgtcggcgccgattttgaaatgacaatcgacacgccgatttttgcggcttttaataaaacctctgaggaaatccggccgctgaagacgatcagcttgtcacggacgggcattccgtttttcaaacagcagccgtacagcttatccagcgcgttgtggcgcccgatatccgtcctcatcaagagcagcttttccgtatcgcacagcgctgcattatggacgccgcccgtttcccggaaggtgccgcttccgctttgcatctccttcatcaggcgaaggcacgtctcaggagttatggtaatccggctgacggcggttttggccgttttcacatcctgctgaaagtaaaaatggcggcctttcccgcagcatgaaccgatgaccctcttcgtatagtctttttgctcaagcactccgggattcgtcagttcaacatatgcgaacccgagactttcatctatagtaaagcttttgatctctttttcaaaacgaatgacgccttctgatgcgagaaatccgatgacgagttcctctaaatggtcaggcgtgcagacgagcgtaacaaattcctgcccgttcaccatgacggtaagcggatactctgaaaccatccgatctgccgtctttgttaatacccctttttcatagcggtatatgtctcttaccgctgttgttttttcatccactgttttcccctccgcagtatccttctcttttattcttccacaatccctgtattttgtcgaatttgcggtttaaaaaaagagccctcttcggactctatgtttcattgcgatgatgtctgctcagaatggtgaataaaataactgcggcgataatggccaatatactgacgaatatgaaggcggcaagcttcagaaaaatccctatcagaacaaaaacgactgccgccagcaccaatataatgcctgctccttttaacaacagcgttcatctccttttatccgtatcattcccgcggttccgttttctaaacaaaaaaagacgccgcacgggcgtccttttttaacctattcttttgctaaatcctttgcggcgtcttcccaagcctgtttgaactcgtccgcgctgtcagctgagacgtatgtgccgcctcccgcttccgccgctttttcaaggctttcgcttcctttcatgccgaagttgaagccgatgatattgacgaccgtgttgacattcgctttacggagcttttgaatttcggcttgaggattcccgccgcatgtttcttcaccgtctgtgatcagatatacgacgtttttccctttagcgccggcccgctcaaattcttcacgtgtatcagaaagcgctttcgctatcggtgtccagccggtcggtttaatcttgctgagtgattgctcaaatggagtcacggcgtacggctgaaggccgtataacgtttctgtcgcgttacatgatacggctttgcctgagtttttattattgcccttatgcccgaatacccgaagcatcagattcgtgtcttcaggaagaacttccgcaaaagaagtgacagactctttcgcaacatctattttacgctctccccctgttttttgtatcatgctcccgcttgcgtcaaacagcacggcgacgtttgtttcttcgtgctttttctcagctgcaaaaacaggtgatccgagtgaaagcgtcaaaagtccgacaatccccgcagtgaacatttttttcatttccttcattcctctccgtttgtttttggccgatgggcccccggctcttctctatgctagatgaggagtatgcaaaaagatatagggcgggattccttttgtataagcggctgtacgccgttaaaaatgaacagaattatgcgcatcatcctaaaaagattggataaatgatgacagatttaatgcctttttcgccctttttgtaatataagtccggaatctgattctttttacagttttctcttcatcttttcttgaaatttttgttaaataaaaataaaaaaaagggccgctaaacggcaccttttcttatttcgctaatgaactcgcttccatcgtaaagatgcggttcatatccttttggctgtgagcttcgtaatattttcctccgcccgcaccggcaattgcgtgaagctgtccgttgaagccttctttaaagtcaaagccgatcacgttgactttaatatgatgtttgcgaagttctttcgctgtcttaataggatctccgccgcatgtctcctcaccgtccgtcaacaggtaaacggatttaaagccgaatttatgaacgccgttaaaagaagccttcgcatcttctaatgcttttgcaatcggtgtccagcccgtaggcccgattccgttcagagagttgaggaagctctgtctgtcaaacttttggaatccgtatacaccgcgaatggattcacaagattgaacttttccggagtttttattattgccttccgaaccgaaaaccgtcattctgacctgtgatgtagacttaattcgatctgcaaaacggacgatttcatcttttgccatattgtatttagaaacgccgtcaatccgtttcgccatactgccgctcgcatcaagcagaatggcgatattgtttttaaataaaaatgtcttctcgtttgcattctcggcagcaaaagcaggagatgcagcagtcagcatcaatccgagcatgattatgagtgaaagtgtttttttcattgcttcttccccttttcaatagatttacgttcaacgccgaacaatatttatcgtaaatgagatgaaaagggaaataaataggacggcgttcctcattatttttgcgtatattcacatagatacggcatttttatcagtgattttcacccggcgctcagccttcagacggcatttgtcagcctttaggctttcgttatatgagtctgttggttgctttaccgtttatggaatagttttcaaaaaaaacagacgctcatgaaagcgcctattttttcgccatatatttgtttaaaaatgaatctgcttcggatatgtccactccctgataataatgcttgacgatgtccgccacggatttcccctgctccgccatgtaattggccccgtactggctcatgccgacgccgtggccgaatccttttgtcgtaatggtgatgctgccgccgttccgtttccattcaaagtcggcagaacggagtccgagtttttcccggatgtctcttcccttcagctttttgccgtttatgacggccgtcgccacttgatggcccggcgttctggctgtaatctgccctaccgtgttttgtcccgagagctgtacgccgagcttttgctgaaactccggcacactgaaggtctgggtggcaagatatttcggcgattgcttatcccacggacttttcacgctctttaaataaggaatggcgcttgtccaataggcttccgcattttccgtatacccgttgctcgtagagaagaaagatgcctcaatcggcttgttgtcgtacgttaaaatctttccttgcgtgcctgcgaccgcgtttgtgattttcttgaggttgtgtgcgtacttagaaccccattcttttttcagctggcttttgctttgatagacttggaacatttgcgtatcgtccaccagtgatcctttcggcgcctgaacggctgagtcagcaaccatcaatctgacgatgaatgtccgggcggcgagcgcctgggcttttaaggcttccggtttaaaggttgcgggcatttcggaagccacgacaccgatcacgtactcttcaagcggaatgttctctacagaatgattggatgtccgataaaccggaatggatacaggtgattctttcaatgtttctgctccttttgtttctcgtgtggtgtgtgttgttttgtgtccgggctctctgtttacggctgctcctttttccgcctgaaacggaagaacgagaatggtgggaacaagaagaataagtatacacagcccggatagtagaaatacaatcggtttcatatatcagctgcctcctgcttgggattcgactctacttcatcttatgggcagggacaagctaatatgacttccttttggacagaatcttattccatttttcacgcgaaaaacgtattcttttttgaaaatcagagcataataatgatgataaaccataaaaaaacagtatgccagattgacatactgtttttacagccattatgcgtttaggtcagttacgacttctttgctttcttgttcagcggccgtttcatcaacgacacgctcgatgtcagcgccgagagccgcaagttttttatggaaattcacataaccgcgatccaagtgcttcagttccgtgacgcgtgtatgaccttcagccactaatcccgcaagaatcagcgccgcgcccgcacgcaggtccgtagcggcaacttctgcgccttgcagctgtacaggaccgttaatgatcacagaacgtccttcaattttaatgtcgccattcatccggcggaattcttcagcatgcataaaacggttttcaaacacagtttcagtaatcatgcttgttccgctcgcacggagaagcagcgccatcatttgcgactgcatatcagtcgggaatcctgggtgaggcatcgttttaatgtcgatcggcttcagctgggcaggaccgatgacacgaaggccttctccttcatccgtaattttgactcccatttcttccattttcgcaattaaagacgtaagatgctcaggaaccgcacctttgactaatacatttccttccgtgatagccgcagccaccatgaaagtacccgcttcaatacggtcaggaatgatgttgtgtcttacgccgcgaagcttctcgacaccttcaattttaatggtgcctgtgccggctccgcggatttttccgcccatcgcattgatatagttcgctaagtcaacgatttcaggctcttttgccacgttttcaagcgttgttgttccttcagctaaagcagctgccataatcaagttttctgtcgcacccacacttgggaaatctaaatagatttttgcgccctgcagacggccttccacttctgcttcaataaagccgttgcctactttgatttttgcacccattgcttcaaagccttttaaatgctgatcaatcggtcttgagccgattgcgcaaccgcccggaagcgctactcttgaatgacccgtacgagctaacagagggcccataacaagcactgacgcgcgcattttgcgcacatattcaaaaggtgcttctgtttctaaagcgtaagaagcgtttacggtaacttcattattctcaaaatgcacatctgctcctaaatgacgcaacacttcattaattgtatatacatcggagagcgtaggtacatcacatattacgcttttttcttcacttgctaataaagatgcagcgataactggtaaaacggcattttttgctccttcaactttcactgtgccgtttaacttctgaccgccgcggacgatgattttttccaaggtattcccctccgcgtccctatattctctatattaatattcagttgtcacgattggtgtgccaaccgtaacggtatgttttccgcccattcccgcacttctaagcgcaacttgcacattcatcttatgtttcgatgtcatgatgtaatctgtccacttatatgtaaatgcagaaacagaaacgaaatgaggctcaactacatgttcaactggacttgcttcaaattctttcatgagctgttctgcttttttttgcaaaacaatactcatattatcatttaaatgaccctttagacaagtaaaaataaatactttattttgaaatatgtcatgtgcctgccgttcaaactgttcatatgtatcattccagttttccggttgctccgggctcatttgctcatataataaatacgaagttgggttctggtttttgagggtagtgacgagctgcagtttaaaagttgtgtgattttttttgtcagaatacgtgccgacggcctttacgattttatcttcccgcgcggattcccaatgatattgcggatactgcgtcttcagttcttttaccttgtcatcaaattcactcagtgacaggttcagattttttttcgcatgaagcgtccattcatccacagtgacctgctgccgctccattccttcggcaatctgggcaagcggagacagctcacttgcatgaatggaatgaaataccgctattaaggcgcttaaaaaaacaaaaaacaagatgatacggcctgctctttttttcttcatatcgatctctcccccttactcccatttttgccggagccggggaaagcaatacatggaaaacttcgtcaaaactcgccaagcgggtgaagaaaaattggtttctcacccagcgattcccttcatttcaacagacgaaacatcttaaaataagtatggaagctgtttcgaataggtaagataatctaaaaagaagttggcgactgccgtaccgatcgcaatggtaagaagaatgatcagcagcctcgcctgcactatttttccttttcggatcagcggatcaaagttgacggcctgaagcgcccaccatgtcaccgcaatgcataccaggtgaaccaggatgctgattgcggcctgctgccccaatacattcacaaattccatctcctttcattttttccgcccctcatatcctctcttattatataagaagaagagagaaagatgatcatttttacatcagaatttttatccaaaattaggggcaatccccgcttaaatgtccgttctccggcatgatatacttttttggaaaggagatgggaatatgaatcattccttttttcatccggaaaagcagtatggagaaacacttcccgtatttgaccacgagtgggaagcgatagcattctactatgattatagacagtctcaaacagaggaactgaaagaattatgtcagtttttcaacatttctcttgattattcacccggcagcctgctggcagtggaagctctttacttccgcagcataaaagagctgcttttggcggattggaacctgccgattgacgaatttgagaaaatgctcagtgtgtatgtcatcgattgcgccatcagacatcatgacgatgccgaatgggtcgtcaaaccttatccgtatacggacggcgcttatacgacgggtgtgcggagaggaaacaaaacgtggcacaccgacaactgctgcgaacatttatatctgcaaaaagaagaggatcatccgcttatcggcgtctatgaatctcttatgcgttaatatagaaaaagaatccttctcagacagccgagaaggattcttttttagtttcctgcaacatccaatctgtttacagcccgctgtaacgcaagctcagcccgacgaatgtcagtatcatctgatcgtttgttcaaacggtcttccgcccgctttttcgcagcaagggcgcgctctttatcaatgctttccgctgtttcagcggcttgtgcaaggatagtgacctgatcaggacggacttctaaaaatccgccgctgacagccgccaattcggtctgcccgtcttttttaaggcggacagcgccgattttaagcggagccacggtcggaatatggccaggcaggataccgagatcaccgctctcggctcttacactcaccatttcaatatcagcatcatatactgggccgtcgggagtaacgatattgactttaacggtcttcatgcttttaccctcctaggaccagattaaacttctacacccatctcttttgcattctcaatgacttcttcaatgcgtcccacaagacggaatgcatcttccggaagatggtcatatttaccggaaaggatttctttaaagcctcgtaccgtttctttaacaggcacgtaagaacccttttgtcccgtaaactgctcagctacgtggaagttttgagaaaggaagaactggatacggcgtgcgcggtgaacgacaagcttgtcttcttcacctaattcgtccataccgagaatcgcgataatatcctgaagttctttgtaacgctgaagcgttgactgaacttcacgcgccaccgcataatgctcttctccgacaatttccggagcaagcgcgcgggaagtggaagccagcggatcaaccgcagggtagatacccatttcagttaatttacgctcaaggttagtcgttgcatccaagtgagcgaacgttgtcgccggagccgggtcagtgtagtcatcggcaggcacgtagatcgcctggatagatgtaactgaaccaacgtttgtagacgtaatacgctcttgaagctgacccatttctgtcgcaagcgtcggctgataaccaaccgcagaaggcatacggccgagaagcgcggaaacctctgaacccgcttgtgtgaaacggaaaatgttatcgataaagaacagtacgtcctgtccttgtttatcacggaaatgctcagccattgtaagacccgtcagtgctacacgcatacgtgcgcccggcggctcgttcatctgtccgaagaccatggctgttttcttgataacgcctgaatcgctcatttcgtagaaaaggtcgttcccttcacgagtacgctctcctacaccggcgaatacggaaataccgccgtgctcttgcgcgatgttgttgattaattcctggattaatacggttttacctacgccggcgccgccgaacaatccgattttaccgcccttgatgtaaggagcgagcaggtcaacaaccttaatccccgtttcaagaatttcaacctcagttgaaagctcatcgaatgaaggagctgatctgtggatcgggtccttttgagcatccgcaggcagcggttcatttaaatcaattttatctcccagtacgttaaatacgcgtccgagagtcacatcaccgactggaacggaaatcggcgcacctgtatcaacggcttccattccgcgctgaattccgtccgtagatgccatggcaattgtacggactgtatcatcgcctaaatgaagagcaacctctagcgttaggtcgatgcctacttcattttcgcctgtagctggctgtgaaactttaatcgcattataaatcgcaggcaagtggccgtcctcgaaacgtacgtcgacaaccggtccaagcacctgacttacgcgtcctttcttcatcgctatccctcctgacaaaatctttctattctaaagcggctgcaccgccgacaatttcggtaatttcttgtgtaatcgccgcttgacgcgcgcggttatatgaaagcgaaagtgaatcaatgagttctttcgcattatcagtcgcatttttcattgctgtcattctcgcagcgtgttcacttgctttactgtcaagaagcgcgccgtaaattaagctttccgcatattgaggaagcagcacttcgagcacctcttcttcatccggttcgaactcgtaagaagccgtgcgcttcccgccgctcgttccgaaatccgttaaaggcagcacttttttctccgtcacttcctgtgaaatcgcactgacgaaatggttatacaccaaatgcagttcatcaaaagcgccgtcgataaacatttgaaccgtctgacgggtcaaatctttaatctgagcaaaagtgacctcgtcgccaagccccactaactcagacaaaatcggcatctcccgttttttgaagaaatcgcggccgactctgccgattgcaatcaccgtgtattcatctttagactgatggcgttcttgaatggtgcggtaagcgtttcgcaaaaccgaactgttaaacgcacccgcaagcccgcggtcagacgtaatgacgagatacgccgtctttttcacttctcttgagacaagcatcgggtgtttcgcgtttttcgcgccttttccgacgttaaacacaacctcctggatcttatccatatacggagcaaatgacttcgcgttggtttccgcacggttcagcttcgcagcggataccatctgcatggcttttgtaatctggcttgtttttttcgttgacgtgatccttgacttaatatcgcgtaatgaggccaaagatttcaccacctttattcttcatttgcgtaaaaagagagaaaaagagaacctttttctctcatcttctaagggttagttgcttggtgcaaatgtgcgtttgaagccttcgattgcagctttgaagtcttcatcagcaggaaggtttcctgttttcgcaatgccgtcaagcagatctttatggttttgatcaaggtacatgtagtactcttcttcaaaacgtctgatatccgcaaccggaatatcatcaagatatccttttgtcagcgcataaagaatggctacctgtttttcaaccggaagcggcttattcaagtcttgcttcagcacttcaactgtacgcgcaccgcggttcaatttcgcctgagtcgcctggtcaagatcagatccgaattgggcgaatgcttcaagttcacggtatgaagcaaggtcaagacgcaatgttccagctacctttttcatcgctttgatttgggctgacccgccgacacgggatacggataatccggcattgatcgcaggacgcacgcctgagaagaatagatcggattgaaggaaaatctgtccgtcagtaatggaaatgacgtttgtcgggatataagcggagatatctcctgcttgtgtttcgacgaacggcagcgccgtaattgatcctgcgcctttagcgtcactcagcttggctgcgcgctcaagcagacgggagtgaagatagaatacatccccagggaatgcttcacggcccggcggacggcgaagaagcaatgacagctcacggtaagcggccgcttgtttggataaatcatcatatacgacgagaacgtgcttgccgttgtacatgaattcttcacccattgtcacccctgcatacggtgcaaggtaaagaagcggagccggctgtgaagcggatgccgtcacgacaatcgtgtaatcaagcgcgccgtgcttacgaagtgtttccaccacgccgcgtactgtagattctttttggccgatcgctacgtacacacagatcatgtcttgatctttttggtttaagattgtatcaatcgcaacagatgttttacctgtctgacgatccccgataatcagttcacgctgtccgcggccgatcggaattaacgcgtcgatcgctttgatacccgtttgcagcggctcatgtaccgatttacggtccattacgcctggagcctggctttcgatcggacgtgttttgcttgtcagaatcggacccagtccgtctaccggctgtccgagcgggttgacgatacgtccgattaattcttcacctacaggaacttccatgatgcggcccgttcttttgacctcatcaccttcgcggatatctctgtaaggtcctaagataacgatacctacgttggattcttcaaggttttgagccatacccaaaacgccgtttgaaaactcaacaagttcaccggccatacaattgtcaaggccgtgtacacgcgcaataccgtctccgacttggatgactgtacctacgtcatgaacttcaatttcagattggtaattttgaatttgctgctttatcagcgtgctaatctcttcagctttgatgctcacttaggtttcaccccttctatcgatttcctccggcaagttgacgttccatgcgctcaagctttccgcttacgcttccgtcataaatccggtttccaatgcggactttaatgccgcctattaaatccgtctgcacttcatttctgattctgagcgaagcgattccggctttttttgcaaacacttgagacaatgataacatttccgcttctgaaagcggctttactgaataaacaaccgcgtcctctgtctgacgggcctgattggcaagtttgataaactcgtctgtgagatcaggcacaatcgaagaccggcggcggtcaatcagaagaaaaatcgtatgcagcacagactcagacagtgcgccgaacgattgctgaatcagctcttttttcttagcggccgataccttcggatggcttagcacttcctgtaatccggcttcgtttcggaacacttcttttagtacggtaagctcttcttcgatttcattgatttgagaagtctcaacggcaatgtcgaaaagcgctgacgcgtatcgtttagagacagcagatccactcatcggctttctcctacctctttaagatagtcctgaatcagttgttcctgggcttgttcatcaagctctttttcaatcactttcgatgcgattaagacagaaagtgatgcgacttgctcgcgaagtgcggaaaccgcttgttctttttctttgacaatttcggttctcgccgcttctttcaatctttcagactcggcgcgtgcagcctggataatgtcttccttctgcttttcacccagttttttcgcattttcaatgagtgattgtgattcctgtttcgcttcttttaaaagaacgcgctgctcttcaatcagcttctgcgcttctttatttctttcttcagcggacgtaatttcgccggcgatatgatcttcacgctgtttcattatatttaatagcggtcccagagcgaatttcttgagaagcgctaataaaactaacatagctaacaattggaataggatatctccgccgttaaacgacagtcctaattcaagaggtaattgagacatctactacggcaactcccttctgcaggttttctctgctgataaaaagccgtttcgggacggcctgcttatcagacataaagcaatggcgaaggttctcttagagtgatcttcgccatttttagttcatataaggcttttttgcttagccaaagaacgctaagaacgcgataacgacagcgataatcggaagggcctcaaccaatgcgatacccatgaacataagagttctaagttcttttcctgcttccggctgacgggcgattccctctaccgtacgtgaaacgatcagaccgttaccaatacctgcaccaagtgcacctaaaccgattgcaattgcagctgctattaaattcatgaaaaagttcctcctttaaaatgttatccgaatggatatatgattttaatgatcatgactgattttgtgtgacatgtacaccatcgtcagcatcgtaaagataaatgcctggatggtaccgatgaacaagctgaatgcctgccatgcaagcatcggaataatggctccgactgtgccgaccaaaccgagaaagaaactgtttgagtagaaattcgtcgccagattcgcaagcaggccaagaagaatttccccggcgaaaatgttaccgtaaagacgaagtccgagtgtcagcgtattcgcaaactcctcaatgatcttcatcgggaacataagcggaaccggtctgaggtaatccttagagtattccttcaaacctttcatcttcacgccgtaatagtgcgttaacgacacaaccataacggctagagtcagagtaatagccggatcagccgtcggtgatttccaccaaagctcgtgtccgaccgttacagaaaacggcagccctagcatatttgatacaaatatgtacatcagcaaggttacaccaagcgccaagaagttagcccctgtttttaaatccattgtactgcctataatattgcggacaaaatcaacaatccattccatgaagttctgggcttttcccggacggatggacagcgttcttgtagtaagaatcgcaatcagcagcacaatcacacttgccacagtaatcatcagaatgtttgtcagattaaaagtaagaccaaacaaatcaatagttctgtaatcgtgattcaatgggttttcacctctcttccattgatgaacgtttgagctgaataatggaatctatcataatgacgggataaattgtcattaatccaataatcacacttgccacactgactttatcgggatatttaaaggcgacagccatcgcaagtatcgcattgcaccaacgcgctgcgctcccgagtgatcgtatggactttcctttcgccacggccttgtcaaaagcattcattcttctggtcaagagccacaaattaaacaaactgaaaacagttcccaaaaagaggcctaaaaaaacagttttatacgccgtaagaccatatcccagcaaatagattgctaagattacaaatacatatctccgttgtctgctgaatgtaagattgggatcgtccatcaactatctgtctcctgatgaaaatgtaatataattcctggatacggcaaaacatgcggttaacccttgcagaaggccttttttgtccgcaaaacggcctgttcgaaaaaaccactcatcctcctgatgctacgggatgctgtttcattcgcttagataaatcctcatataacgggtttttttggaggatttaaaatgaggatggatactagaaatgaaaggaatgaaaaccttctcataataccctcgtttagcatacaatagccctaacatgtgtcaatctgtttaaagttaaaaaactttttataccggaagcatacacagaatgttcacaaattcacctataaatgtatgacctctgcccattcagctaaaatctggataaaaaaaagaaaacccctgaatgaggttttccgatttatttggttccgtacagtctgtcacccgcgtcaccgaggcccggaacgatatagcctttttcattcagtttttcatcaagggcggcgatataaatatcaacgtcagaatgatgtttctgcagctcttccacgccttccggagccgctacaagacacataaaacgaatgtttctcgcgccgcgctttttcaggctgttgatcgcttccaccgcagagcctcccgtagcaagcatcggatccacgacaataaattcgcgttcttctacatcagaaggaagcttgacatagtattccaccggttttaaggtttccggatcacggtataatccgacatgtcccactttagcggccgggattaatttcagcatgccgtcaaccattccgagacccgctctcaggatcggcacgataccgagtttcttccctgaaatcactttggatgtcgctgtttgaacaggtgttttcacttccacttctttaagaggaagatcacgtgtaatttcaaacgccatcagtgatgcgacttcatccacaaggtctctgaaatcctttgtgcctgtattttcattccgaatatatgtcagcttatgctggattaaaggatgatcaaatacgtaaacctttcccatactgtgttcagctccttttttgttgtccgagtgactttttcacacttctattgattctacagaaaaagacaaacagtttcaagaaaatcataaaaaaacccgccggattaaggttccggcgggtttcttccttattaatagtccagttctttatataaaggaaacttttcagtcaaggcagatacgcgctgtttcgcttcttcaagttttgcttcgtcttcatgatttttcagcgcgaggccgatgatggcgccgacttcttcaagcgcgtcaccgtcaaagccgcggcttgtcacagccgccgtaccgagacggattccgcttgtgacgaacggtttttccggatcgtaagggatcgcgtttttattagatgtaatgccgatttcatcaagaacgtgttcagcgacttttccggtcagtccgagagaacggaggtcgacaagcacaaggtggttatccgttccgcctgatacgagctgaataccctctttgttcagagactcagccaggcgcttcgcgttcgagatgacgttttgcgcatatgttttgaaatcatcttcaagcacttctccgaaagaaacggcttttgccgcgatgacatgcataagcggtccgccttggattcccgggaaaatggatttatcaatcttcttgccgaactcttcacggcaaaggatcattcctccgcggggtccgcgaagtgttttgtgagtcgttgtcgttacaaagtcagcgtaaggaaccggattcggatgaaggccggctgcgacaagacccgcgatatgcgccatgtctaccatgaagtaagcgccgacttcatcagcgatttcacggaattttttaaagtcgatcgtgcgggggtatgcgctcgctccggcaacgatgagtttcggcttatgcgccagcgctttttcacgcacatcttcataatctatatattgcgtgtctttatcgacaccgtattctacaaagttgtattgaacgccgctgaaattaaccgggcttccgtgtgttaagtggccgccgtgggagaggttcatcccgagcaccgtgtcgccgtgctctaaaatcgtgaagtaaacagccatgttcgcctgagcgcctgagtgcggctgaacgtttacatgctcagctccgaaaatctctttcgcgcggtcgcgggcgatgtcctcaacgacatcaacatgctcacagccgccgtagtagcgtttgccggggtagccttcagcatatttgtttgttaaaacagagccttgtgcttccattaccgcttccgtcacgaagttttcagaagcaattaattcgatcttagtctgttgacgcttacgctcatctttgatggcgttaaacacttgtttatcttgtacaggtaaatgtttcatcagcgagatcctctcctatccgtttcctgttctttatttttaccaccttattgtacatggtttttcaggtgaatgtaacagcttatttaaaaaaatcacaaaatttaattagaaaacacgaacattatagaggaaaagtattttcatcattcgcattcatatacggcgcgaattccgcctatcagcttcggtcttgtccgggccatcgtcacatgtgcttctccaagctcacggctcgatatccggacagggacggcaacgggtttcagatgcatgccgatgaacgtatcaccgatgtcaatcccggcgtcagcctgaatcgattcagcgagcactggagaacgcatctgccggtatgcataagaggccatcgctccgcccgctttcgggacggggacggctgaaacaatggggagcctgaaccgctcggccgtttccgcttcaatgacaagcgccctgtttaaatgctcgcagcattgaaaagcaagatgcacacccgttttttccttaaaccggttaagtccgccgtatatcaattcagcccaatccccgcttccggcggtgccgatccggcttccggcggcttcacttgtactgcacccgaccaccagcagactgccgtccgtcagtcctgcctgctcttgaaactcagtcagcatgtccgtccatttttgcttcatctcttccattgtccagcacctcttacagatttttttcttcgtaatctgcgattttgccgatccgccgttcgtggcggccgcccgtaaattcagtcgtcagccagacttttgcgatttcgcgcgccagccccgggccgatgacgcgttcgcccatcgcaagaacattcgtgtcattgtgttcacgcgtcgcttttgcgctgaaggtgtcatgggcaagcgcacagcgtatgccctttaccttatttgcggagatgctcatgccgatgcctgtgccgcaaattaaaattcccctgtcagcttcgccgttcaccactttttccgctaccggaaaagcgtagtctgaataatcgacagagccggcgccgcattcacagcccatatcaatgtattcaatctgcaattcatccaaaagactttttatttcttcgcggatatggacgccgccgtgatctgacgcaatagctactttcattcatttacctcctaggtgtggctgggcgaagacagcccagtgtgcttgtcctttttattacgaaatccgttgatttcattctactctttcacattcgttttgcaaatgacctgtttgcagattttctgacagattacttgcttttcccgtcaagcaattgatcagccaaaagggtcagcagctcctccagttcgtcccgcgtctgtttataaacatcaagcggaccgccgaacgggtcagagatatcgccgctttcccccgtcacgtattctttaatggtaaaaactttgccctgactgttttgatatcggccttcaatcagctgtttatgctgttcggtcatcgccagcaccagatcggccgtctcgatatgttcttccgataagggagatgaactgtgattgagggcgatccgtttttcaaacagcgcttctacggcatgagccgacgcttttccgtgcggagacgcgaatacgccggccgagcttacgctgacatccagccctttcgtttctgctatggatttaaaaagagcctcagccatgggactgcggcacgtattgcctgtacaaacaaagattattttcatgtccgtcacctcttactacctattataaatgaagaaaaaagaaacggcatcttcgtttctttttttacgtatcttatatcggtaaaagcagtttcagcccgaatccgatcaaaatggctccgccaagcgcttcgctgtaggagccgagccatgactgcacctttcttcccgccaaaaggcccgcccatgttaaaacggtgctgaagaccccgaacagcgtaacggccagaaacggattggagccgttcatcccgagactgagcccgacagaaaagctgtccagactgacaccgaccgcaaacagcaacagtcccgagcctgccggagatatgagcggcccgtccgattgtttaaacgcggcgatcatcatctgcacccctaaaatgaaaagaagagatccgccgatgtaaacggcgagcatccccagaaaaccggacagcagatgcccggccgccattcctacaagcggcatcatgacatgaaacagcccgatgacaacccctatatgaaaaatctgttttttcttcagctgaatcattcccattccgagcccgacggaaaaggcatccgtccccaaagcaaatgccatgatgcttaaggagacaagttccccgatgaatagattcgacatgaataaaaacccccttggacgtgcccgcttgtttagcttatgcatgtccgataaggggtagaacaagttaatggataacggtgccgcctgcggctttcatcagcctgttcataacggcgagccccactccggtatccggaaaggactcagaaataatcatatccacttccgcttcatcaaagctgcggagcgcatcgtataaggcggacgccactgtttcaaggtcggcgcgtctgccgcagaccttgatataatcagcctggtaactatcggcgttctcttctgttgtcaaaatgccgattcgttttccccggcttttatatgcgtctgccagttcttgaattctccgggcgccgccgtcggcaatagccatcggcgcagaaggcgcgtaatgtgtatatttcataccgggagaaataggaacctcatcttcttcggtcagtcctttatccacaagaaccggaccggcggcggattcaatctgctcttttgtcacgccgcccggacgaagcagcacgggctgtttccccgtacaggacagaacggttgattccactccgattcccgtcgcgccgccgtccacaataccggcaatacggccgtttaaatcatgagctacatgctcggccttcgtcgggctcggttttcctgataaattggcgctcggcgcggcgatcggcagtccggccgagctgatgagggctaatgctgccggatgatcaggcattctgaccgctaccgtctccagtcccgcggtgacacggggtgacagcacaccgggcttacacggcaggacaagggtcagcgcccccggccagaatagctccataagctttttcgccgtctcaggaatatggctgataaaacgatcaagctggctgatatgggatatatgcacaatcagcgggttatcgctcggccttcctttcgcctcatatattttcgttacggcttccgtattttcagcgttagcgcccagtccgtaaacggtttctgtcggaaaagccacaacctcattctgccggagcaattccgcggcttgtgtaatttggggatcggttgtggataattctgcggaacaatccacaaaccatcttcttgttttcatgtataaccaaactccttattttaaagcggtaaaactttattttctctcgtgtattccttttgaaagtataaaagatgtcctttaataaaacaagcgttatccacaaactgtggacaacactttttaataagtggataaccttgtgtataagttagatcaggcagaggttttcaccattaaaaacgaaccttctgtgcataacgagttgcggaaatgttcggacgtatacagttcctcaggcgcatcggcgcacgcttcaaatcccatcacattcagaaactcagcagatgagggctgattggcgactaagtagacatcttgaatttcatgttttttgcacagcacatccatactttgaaacagtgtaacgatatggctttgattcagcctgtccgacatgacgagtgaacggagaagcccttttccgccgctgaatttttcgatcccgagacaggcggcaatctttttttcgctgtcttccagcacgataaaccggctgatctgctgatcgatttccgcatgtgccgtatcagactttttcaaaaaggcctccagcgcctccgtatcttgatctcttgccactctcagctgataaaacatatatttccctccgtttcgatcaactctttcttccaatctatgaatcgaatccggatttatgccttttgcttcaggaaaatagatctgaaatccaatcgacgaggaaaaacttcacttcggtatcatcgtcatctttattttctttcttcgctttatcggcctttgcttttacgtcatccagcactttttctgtctgtttctgcgtttcttcctgcttctgtccgccgtcttcctgatctttcaccgcttcgccgtttgagaaatcaaggaagcacagcggcggaaacaagacgcaccaccagttggcgccctcgccattgccgagtgtaattaaaatggcttcatattttccggccggatagaccatattgccgtacagctttgtcggaaacgagattttattgaattgaactgaaacggattgatgcgcacccttttctttcatcgtttgtttggcgatttctttaatttcaggaagcttcgaacgaatgagccgccgcgcttcttcaatggaagtgatatctttcacccagtccgtgatttgcttgtttacagcatctctgatctggcgcttgagcttttgatcctcatcgttatcactgttggccaaaatcctgagccggatcgcttcatccggtatgacgacgggctcatcggctgatgcccgcgccgtttcttcttttgtcaaacccgcaagcgctcctgataataaaagaaaaatatatatgcagatcatcattgtctgtttcatcggtccccaccgttcctctccgtgctttttttatctagtcccattatggacatgacggaaaaggtttaaaccggcgggaagaaaaaaatctagcaagctgataatctgcattgacagattcaaaatatggtacgatattattttgataggaggttttcagatgaaatataattacaccgtgctgctgtcggcggcatgtatgtctgtcatttattctattttgtatgttcatcaattcattatcgcggctttcatttcgatggcgttttattttttgtttccttatttgatttttgcgctgccgcttcaatactttctgaataaaaagccgaagagatttcatccgctgtattttctttattatttgggggtgtcgttcattgcaaacgggatcatcttcggtcttttgcagccgtcaggccaatctctgttttctaattcagccttttatatctttgcggttttaacagccgtcgtctattgggtatgggattccgtattgctgcaaagacaaaatccggctacagaagcgtaatcagcagacagccggctgaagggagagcggcgcaaaagaaaacggcggccatctttaaacgggcgcgccgtccttcttctgtttcagaatgataattggcccgctgctccgctccgcttacggccagcccggaaacgatgaccgctgcgacgataagaacagccgtaacggcgccgagaatgatgtcaaagccaaacggcaggacaaatccagccgcataagctgcggcggcgagtatacatccgaaggcgaacgcttttttcaaggcggatgcccctttcattttctttccattgtaacaaaagcccgccgtgtgcgtcaccggcgggcttttttcatgatgtgatgaccgcggatacggttctgtcttttccgttgatgtcctgtacgacttccacttccgcattcggaaaggaatgacggaacaggtctttcacggcttttccctgattatatccgatttcaaagacgacaagcgctttatctttcatgacaagaggcagctcctccataaaccgcttgtagaatttcaaaccgtcaccgccgtccgtaagtgcatgaagcggctcatggaaacggacgatatccgacaaatccgccatttcttcttcagaaatatacggcggattggaaacaataatatccgcttttattcctgatgaaataaaaggagttaacagatctccctgcaaaaagcggacgtccgctccgaggttttgcgcatttctttccgccacctgaagcgcttcttttgaaatgtccgaagccgatactgaaaaatgtccgcattcaagcgcgagcgtcaccgcaatggctccgctccccgtaccgatatcaatgacgttcaggcgttctccctcagaaaacacccgcttctgtctgtccagcagatgaaagacgacttcttccgtttccggacgcggaatgagaacatcgtcattcacaaagaattctctgccgtaaaactgttctttcccgataatatattgaatcggaacgccttctttatgcatttccacatgccgtctgaatcggtaaagctcgtcctcgccgacgggctcctgcagacttgcgagaagcttgctccgatccattccggtatcatttaacagcagcagctcggccgcgtttttttctcttcccgcttcggttaaataagaagaagcccagcttagggcttcaaaaacggtcttcatcttaattttccgcctgctggagcttgcttgactggtcttctacgattaacgcttcaaccacttcatcaagcttgccttccaggatttgatccagcttttgaatcgtcaggccgatacggtgatccgtcacacggttttgcgggaaattgtatgtgcggatacgctcggaacggtcgcctgatccgacggctgatttacgggtctgatcatattcagcctgagcttcctgctggaatttgtcatagattctggcgcggagcaccttcatcgctttttctttatttttaatctgagatttttcatcctgacaggatacgacgacaccggtcggtaaatgcgtcaggcgtacggccgacatcgtcgtatttacgctttgtccgcccggtccgcttgatgcgaatgtatcgacgcggatgtctttttcgtggatgtccacttctacttcttccgcttcaggaagacacgccaccgtcgccgtggatgtatgaatacggccgcctgattccgtttccggcacacgctgtacgcggtgcgcgccattttcatacttcagcttggagtatgcgccttttcccgtaatcataaagatgatttctttgtaaccgcccgttccggtcacgtttgcttccatgacttcagtcttccagccttggatttcagcgtaacgggagtacattctgtagagatttcccgcaaacagcgcggcttcttctcctcccgctgctccgcggatctccatgattacgtttttgtcatcgttcgggtctttcgggatgaggagcactttcaaacgctctgataaggtttccgtctctccctgcagttcggagatttcttccttcaccatttctctcatatcggcatcaagcttttcctcaagcatcgctttcgcatcggcaagctgttctgatgcgtctctgtattgtctatagacttcaacggtttcttgtatatcagattgctctttcgaatattctctaagctttttcggatcgttgaccacttccggatcacttaaaagctcatttaatttttcgtatcgttgttcaattgactgtaaacggtctaacacggtcttcacctctgttttcctgtgcgtaacattctcattatagtatagggcttatcaccagtcaaaagcaattcgcctctgttatactgaagcaaaaaaggaggggcggatatgctgaaatccatccaccatatagcaatcatatgctctgattatgaaaagtcgaaagctttttacaccgagatactcggtttcggcattataaaagaaacataccgaaaggaacgggaatcttataaactcgatctggcgctggacggcgcgtatgcgattgaattgttttcctttcccgatccgcccgaacggccgaccagaccggaagccgcgggtctccggcatctcgccttcaccgtaaacgatcttgaagcagccgtcagggagttaaagaaaaagggcgtcggcacagaaccgatcagaaccgatccgctgacggggaaacggtttacctttttcttcgatcccgacaagcttccgcttgaattgtatgaagcgtaacgttttttgaagaaatgccgctttctttggcgaattccttcttgttttgtctaacatgaagggaacgccgcctcatggtcgaatacctagcaaaaaggaggtatgtgatcatgaatacaaacatggccgcgaaagagctcggcgtctccgcaaaaacggtgcaaaggtgggtcaagcagctgaatcttccggctgaacggaatgagctcggacattattcctttacacctgaggatcttgatgtgctgaaatcggtcaaacggcaaatttctgaaggcactgcccttctggacgttcaagtgccccggcagccgaaaaaacggacgggcttcattttgcagcgtccgaaaatcaatggcggcgctgaacaaaggttggcagagctggagcgcaaactggacattctcacgaaagagaaacaggatgagaaccatctgctttcaaggatagaggagcttgaacgccagctgaaacaaaaggcggatgaaggggtgtcttatcagcttcttcagcacagacgggaaattgacgacctcaataccgaattgcagacattggcctcccgcatccaggaacttgcccagacagctcccctctcagaaacagccgcttcttcagaacataagaaacccagaaaaaaaacgagattttcgccttttaaatttcaattctaatcaaaaaagctccctgaaacagggagcttttcattatgcagtcagcgcaatgatgatcggcagtgagataagagataaaatcgcactgatcacgaacgcggacgcagtttcttcctcttgtttttcgaaacgtgtggcaatcatcgccgctaccgcagatccagggaatgcgacgagcaataccgctttagtgatctggtcagccggaagtccgactgcaagagcgatcaagtacatcagcgcaggctgaacggcaacttttaacaaagcgataccgaaagccggcagactgagcttgatgttgcggataccgacagttacaccgacggcaaagagtgcaacacctgatgttgtgcttccgagctgatcaagcattttttcacccaagccagggagtgttacaccgcagagtaccaggatgatactgataagcggtgcagccgcaagcggttcggaaagaccgtgaagaatagacttaccagtcattttccagaagttctcgttttcgctgtcttgtttcttagatgactcaccgactgtagcgataatgatcgcaagcgggtcaaggatggcgttaaccacgatacccgtaacggcgataggaatcgctacttcgtttgctccgaataagcttccgagtaccggaatacccataaatgcaaatgtcggctgtgcagagtttaaagaaaatacagatgaattcgttaaatcatacttgaagataaatttgcaaaccaacaaaatgacgataaagaatccgacaatcccaatgatcaaagcgatcattaaaggaacctgtgataaaaacgcacttcttgaagtggttaaaatacttgcgataaaatgcgccggaagcgcgtacttcgtaactaaggtgcttaccccttttgctgacttcgcgtcataacttccgaagcgacctgcgaaccatcccagcacgatcacgaaaaagatcggcgccaggaggattaaaatatctaagaagctcaaaatattctcctccaaatccttaatgtccgtatactttagcctttacataaaagctttccctcggactgtaaaattaatcgtaaaaattatttagcgataacttgtttatattgcggtttccacattgcatcaagaacggcttgttctacattctcaggaatgcggtttgccacgccttctttaatggcagtttccgctacggcgatcgcaactttaattgaaacttcttgtaagtcgctcatgctcggcagaaggcctgcacccggtgtttcaaaatcaacgctttctgcgattgcgtcagcagttgccgcaaacattgcaggagtaatcactttcgcttctacaacgattgaaccgagaccaagtccagggaacgcgaatgcgttgttagattgtccgatttcatgagaaacgccattgtactctacattgtcaaacgggcttcctgtcgccacaagcactttgccgtcagtccatttgaatagatcgctaggaacggcttcagcaagcggtgtcgggttagacatcggcatgatgaccggacgctcaacgtgttttgccatttctttgacgatttcttcactgaacgcgccgctttggcctgatgtaccgattaagattgtcggtttcgcttgacggatcacttcaatgaaaggaatttgtccgttttcatcgcgtttccaatctttaatttcttcagctgtgcgcaggtacggctcttggaaatcaagaatgttttccataccttcaattaacaagcctctgtagtccattgtgtagaacgctttgttggcttcttcttcagaaagaccggcaagcaccatagtgtcgcggatttggtcagcgattccgattccggcagatcccgcaccgaagacaaccacacgctggtctttaatagacgcgcctgtttcttcatagccgcaagcacacctgcaagcgtatcgcgcctgttccttgaatgtcatcgttgaatgtaagaatttcatgattgtatttcttcatgatattgcgcgcgtttttgtttccaaggtcttcccagtgaagaagagctttagggaaatatttaagcgcagcttttacataagcgtcaatgaaagcttcataacgttcgccttggatacgttcatggcggttaccgatgtataaaggatcgttcagaagtttttcgttgttcgtaccgacgtcaagaacgacaggaataacacggcttgggtcaataccggcagcagctgtgtatacggctaatttaccgatggcgatgttgataccgcctacaccccagtcaccgattccgaggatgcttctgagtctgtcgcaacgatcagatcaatatctccggcagtggcatgaaggttttcaaatgcctcttcgattccttctacattgtcgatagaaaaggtaaatcccttgaggtcttctgtactcatggctgtattcttgaatcgcttcaccgacagtcggtgtgtaacaaccggcagcatttcacgaagatggttttgaagcaatttaaagaaaagaacttcgttacggttttgcaaatcattcaaatacacgttttggcgaaggcggtccggctgagcttgaaactgctcgtatgcgcgttttgcctgctcatcaagagacagaatggtcggaggaagcagccgtctaatccaaggctttttctttcttctgctgaaaacgcaacacctttatttaaagtagggatagtagaacttcttttcctcttaaagtgtttctaagttgccttccttcgtttactttaatatattcaagaaaatctccttctttcttcaaatagttaacaaagttaagtaattacccattttggctagtgtgatcgcgatctgctatatctttttttgacaattattcgaacaatgtctcataactatttacattacttagtcattttatgcctgtaaaaatgaaattcaagagatgaaaattacttaattttttcatactcttttttaagttaattaactacaatttttgaaaaacgtcaaaaaacaccggattttttaccgatgttttcatgaaaagggttatttatcgtctgttttttcagcacttcgtggtgatgtctgcatctcgcttcgtatgactccgacgcgccgactaaaatgaccggatcatcataggagcgggcttccgtcaatcaaacgctgcgtacggcttgccggcgacccgcaaacggagcagaccgcctgcagcttcgtcactgattcggcaaccgccatcagattcggcaccacaccgaacggctctccccggaaatccatatcaagtccggccgcgatgacacgatagcctttatccgcaagcaaggataaatcgccgatgattgattcgccgaaaaactgcacttcatctaccgcgatgacgtccgtgctttcactgatatgatcccatatttcagccgaagacgagatgacgtggcttgtcatggatgtgccgttgtgagaaacgacagcctcctcactgtagcgattatcaatggcaggtttgaacaccttgacctcctgcttcgcatatgtcgctcttttcactctgcggatcagctcttctgatttccagagaacatgctgcgcatatcagctcaagccatccgctttgcttcattatgtacataggctatccgctcccctttttttcctgtttatggacataaaaaaaggcaagaagcaattcttgcctgcctgtaaatctattattacttaagaccgtattttttgttaaagcgatcaacacgaccatcagcagaagcgaatttttgacgtccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattattccggagcgaatccggaacgcatatgagagaattatatcagtcatttactgcatttgcaaatacattttttatcagcggcgggctgatgatgaaaggtttgcctgcttccattcttggttgatcagatcgaagaattcctgattcgtttttgttttttcattttctcataaacttctgcgaagtcggagaatcagacatcgattgcggatcgcccatagacggtcaagatgctctttcggcacgagcagctcttccttcgcgtgccgccggaaaatccgtctttccgcaagagcggttgcaaactctcatagatgacgtcatccatccgggagcccgtgtctacgagcgccgtcgttcagccgcgtttccggaaaaagcgcttcggaattcagccggaagcgtacccgcttggcgggataaccgtctgccatcgttccgcgaccgctcgcggaatccgccgcggccggtcggccggttttgtagagcccgtgccagcgggactgtccatcagaatgccgttttttttttttaacagcatggttttttactaatttggcatcgaacgtcgactgacgacatccgctacgaacccgaccttcggttttcatcaattaagagacgatcaattcagcgtcaggagatttgtcgtaatgtgttagcctttttaacagcatggtttccggctttcggcggagtcagaccgctggccgaaaccgacgggccatcatatttcggttctttcggcgggattcagcgcaccgcacggccgttccgtaatagcgttcgttttcttacgcaccttgccggatactttgtcaccgtttcttaaatcaaagcggcggatctgggaagcagaaatgtagatgtcttctgagcttggcgagtaattaatcggtctgaggaagccgaatccttccgattggatgatttcgagcacgccttccataaacagaagatcctcctgctcggcgttggctttcaggatggcaaagattaattcttttttagtcagtttgctgtagtaggagattttataatgtctggccagttcatatagttcttttaatttcatattttccaaagaggaaatagatacgtctttcataaaaacaccacgcttttcatagtcaatgtattgctgttttcattcaaatcggctgcttcgcatgattccgccaaagcacattcttttataaaacgttcaggaacttctatcggtaacacttccacccatgatcggcgcttttttaaaaaaggaatgtcttaatgagttttgaaggaagcgaggacaaaaacttgagaagatcaatatttatatcgtctgtatgcggtagaatttgaaaatttcccagtactcaaaagaaggaatgacacagaaaaatcgcagcactctttatttttacctcatttcaaaaaattattcaacttaaataatgctttgacatataaatgatagggttgactcttttttgcaaaagaaaagcgggactttccgtcccgcttttctctatttatggccggatcacaagatttggttttttcttcaggctgtgtcttccgtcaacgaatcggaccgttcctgatttcgcccggatgaccaggctttcagtcgtgccgacggagcctttgaactgaacgcctttcagcagctctccgtccgtgacacccgttgcggcaaaaatggcgtcatcccctctcacaaggtcctccatccggagcactttggatacatcaaggcccattcgctcacagcgggcctgctcttccgcactttgcggcagaagcctgccgatgatttcgccgccgagcgcttttaacgcaacggcagacagcgccttcaggagccccgcctgaaccgaagagaatgtctactcccgtatggtcaaaggccgtattgatggcgcccgcgacatcaccgtcgttgatcagtttgattctggcgccccctcacgcaattcagagatgattttttcgtgtctgtcacgatttaaaatggttgccacgacatcttcaatgtctttgtttttcgctttcgcaacggcttttaagttatcaatgacaggcgcttcgatatcgatgcagcctaccgcttcgggaccgaccgcgattttttccatatacatatccggggcgttcagcaatgttccatggtcggcgaccgcgatcaccgtcagcgcattccagccgccgctcgctacgatgtttgtgccttcaagaggatcgacggcgacatcgacgcgcgggccgtatccgtttccaagcttttcgccgatgtaaagcatcggcgcttcatccatctcgccttccccgatcacgaccgtgcctttcatcggcaccgtgtcaaacacgtcacgcattgcgcttgtcgccgcatcatcagcttcatcttttttcccgcggcccatccatctggcagatgctaaagccgccgcttcagtgactcgaaccaattccatcgataagcttctttccatttcaacacgatctcctctcaaaagtccgcatttctatgaattttggagctgttctatctcttcgtccgtcagcctttgccgccagattgtggcgcccagaccttcgagttttttctcaagattgctgtagccgcggtctaaatgctcaagaccggtaatttcggttacgccgtcagccatgagcccggcgacgaccagacaagcgcctgcacgcagatcgctcgcctttacttttgcgccctgaagctcggccggaccggtgataatggccgacctgccttccactttcatattggcccccatccgtctcagctcatcaatatgtttaaatcgggccgagtagatggtgtcggttacgacgctcgtgccgctggctctcgttaacagagatgtcatcggctgctgaagatcagtcgggaatcccgggtaaacaagcgttttcacgtcgaccggttttatctgcttctgcccgccgagcataagaagctgatcgtcactcgtctcaatgtaaaaacccatttccctgagcttcgccgttaaagactccaggtgagtcggtatgacattatcaataatgacttctttccccatcgcggcgccggcgatcataaaggtgcccgcctcaattctgtccggaatgatcgtatgcctgcatccgtgcagcttttacgccgtcgattctgattacattggttcccgcacctttgatctttgcgcccatgctggtgagcaatgtggcaacatcaataatctcaggttccttggcggcgttttctatcacggttttaccttcagccagtacagcggcaagcatgatattaatcgtcgctccgacgctgacgacatctaaataaatccgtgcgcctctcagcctttcggcgcgcagataaatcgcgccttgttcattggtgacttccgctccaagcgcctcaaaccctttgatatgctggtcaatcggccgcggaccgagatggcatccgcccggcagtccgatgaccgcctgtttgaagcggccgagcatcgcgcccattaagtaataggaagcgcggagttttttcactttgccgttgggaagcggcatgctgatcatcggggaagggtcaacgaccatttctcctttttcaaaatggacgtttccgccgatttctttcagcaggtcacgcagcgtttcaatatctgagatctccggaagcccttcgatcgttacttcggaatttgccagaatggttgcgggtatcaatgcgacggcgctgtttttcgcaccgctgatgtacggttccgtttaacggatcgccgccggcaatattcaacttttccatgatagtctccttccataagaagatagctgcggagcgtaaataaaatggcattttattctgtctctgcaaataaagctcttgtccaaaatgtagccaattcgaagagaaagaatacaaggacattataaaataacaggaagaaaatagcgaagctttgcggggcatttttaacacaggatgcacagaggcccgccgggttcatattccggggaaacacactcttcactttgatactgaaggcccgctgccaaacaggaaaacataagggtgcggcaaacggatgcaaccggtttgccgcccttttcccccttatttattccagtcagccaagaattgctcgatgcctttatccgttaacggatgtttcgtcagctggtgaatgactttcagcggcatcgtaccgatatgcgcaccgcgtaaagcggcttcagtcacgtgctgcgcatgacggatggaagctgcgatgatttgagtatcaatgtcatgaatgtcaaaaatctgtcttatttctgaaatcagttcaagaccgttatggccgatgtcatccacggcctaagaacggagatacataagtcgccccggctcttgccgccaaaagcgcctggttggcgctgaaaatgagcgttacgtttgttttaatgttcaggtcgctcagcgcttttacggcttttaacccttcagacgtcatcgggattttcaccgtaatattcggcgcgattttcgcaagttctttaccttcttcaatcatttcttcagcattcagggaaatgacttccgcgcttactgatccgctcacgacttccgtaatctcacgaagtctgtcatggaaagacacgtcagcttctttcgccactaaactagggtttgtcgtaactccggcaagaacgccaagttcataagcttctttaatctcgtcaatgtttgctgtatcaatgaaaaataacataaggaaagcctcccagtaataaattttcagaactgtaaaacatgattgcgctttctaaaggtaagacataaaaccgcctgtcaatgctgtcaggcggtttatggatgttacattggattaagcttggtttgaagaaccgaactcacgcattttgccgataaccgtttctttgatcgcttcacgagcaggtccaagatatttacgaggatcgtattcgttcggcttagctgccaatgtttcgcggacagcttttgcagaagaaatttggttttcagtgtttacgttgattttagccgtaccaagtgagattgattttttaatgtcggcagtcggaattcctgtaccgccgtgaagtactaacggaaggccggttgatttgccgatatcttccatttctttgaaaccgaggttcggttcgcctttgtaagggccgtgaacagaacccagtgcaggtgcaaggcagtcgatgccagtgcgctctacaagttcttgacactctttagggtcagcatagattacgccttcagcgatcacgtcatcttcctgtccgcctacagttccaagctcagcttcaactgaaacgccgtggaaatgagcaagctcaaccactttagctgtagttgctacgttttcctcaaacggatggtgagatgcgtcgatcattacagaagtgaaacctgcatgaatcgctttcgcacaagattcaaagcttgaaccgtggtctaagtgaatcgcgacaggaactgtcactttgtattcttccataagagctttaaccatggcaaccactgttttgaagccgcccatgtagcgtcccgcgccttctgaaacaccaagaataaccggggatttttcctcttctgctgcttgtaaaatagcttgagtgaactcaaggttatttaagttaaattgt
